(12) United States Patent
Liu et al.

(10) Patent No.: US 11,268,082 B2
(45) Date of Patent: Mar. 8, 2022

(54) NUCLEOBASE EDITORS COMPRISING NUCLEIC ACID PROGRAMMABLE DNA BINDING PROTEINS

(71) Applicant: President and Fellows of Harvard College, Cambridge, MA (US)

(72) Inventors: David R. Liu, Lexington, MA (US); Alexis Christine Komor, Pasadena, CA (US); Liwei Chen, Somerville, MA (US); Holly A. Rees, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 669 days.

(21) Appl. No.: 15/934,945

(22) Filed: Mar. 23, 2018

(65) Prior Publication Data

US 2018/0312828 A1  Nov. 1, 2018

Related U.S. Application Data

(60) Provisional application No. 62/551,951, filed on Aug. 30, 2017, provisional application No. 62/511,934, filed on May 26, 2017, provisional application No. 62/490,587, filed on Apr. 26, 2017, provisional application No. 62/475,830, filed on Mar. 23, 2017.

(51) Int. Cl.

| *C12N 9/78* | (2006.01) |
| *C12N 15/10* | (2006.01) |
| *C12N 15/11* | (2006.01) |
| *C12N 15/62* | (2006.01) |
| *C12N 9/22* | (2006.01) |
| *A61K 38/00* | (2006.01) |

(52) U.S. Cl.
CPC ............... *C12N 9/78* (2013.01); *C12N 9/22* (2013.01); *C12N 15/102* (2013.01); *C12N 15/11* (2013.01); *C12N 15/111* (2013.01); *C12N 15/62* (2013.01); *A61K 38/00* (2013.01); *C12N 2310/20* (2017.05); *C12N 2800/80* (2013.01)

(58) Field of Classification Search
CPC .................................................. C12N 2310/20
See application file for complete search history.

(56) References Cited

U.S. PATENT DOCUMENTS

| 4,182,449 | A | 1/1980 | Kozlow |
| 4,186,183 | A | 1/1980 | Steck et al. |
| 4,217,344 | A | 8/1980 | Vanlerberghe et al. |
| 4,235,871 | A | 11/1980 | Papahadjopoulos et al. |
| 4,261,975 | A | 4/1981 | Fullerton et al. |
| 4,485,054 | A | 11/1984 | Mezei et al. |
| 4,501,728 | A | 2/1985 | Geho et al. |
| 4,663,290 | A | 5/1987 | Weis et al. |
| 4,737,323 | A | 4/1988 | Martin et al. |
| 4,774,085 | A | 9/1988 | Fidler |
| 4,797,368 | A | 1/1989 | Carter et al. |
| 4,837,028 | A | 6/1989 | Allen |
| 4,873,316 | A | 10/1989 | Meade et al. |
| 4,880,635 | A | 11/1989 | Janoff et al. |
| 4,889,818 | A | 12/1989 | Gelfand et al. |
| 4,897,355 | A | 1/1990 | Eppstein et al. |
| 4,906,477 | A | 3/1990 | Kurono et al. |
| 4,911,928 | A | 3/1990 | Wallach |
| 4,917,951 | A | 4/1990 | Wallach |
| 4,920,016 | A | 4/1990 | Allen et al. |
| 4,921,757 | A | 5/1990 | Wheatley et al. |
| 4,946,787 | A | 8/1990 | Eppstein et al. |
| 4,965,185 | A | 10/1990 | Grischenko et al. |
| 5,017,492 | A | 5/1991 | Kotewicz et al. |
| 5,047,342 | A | 9/1991 | Chatterjee |
| 5,049,386 | A | 9/1991 | Eppstein et al. |
| 5,079,352 | A | 1/1992 | Gelfand et al. |
| 5,139,941 | A | 8/1992 | Muzyczka et al. |
| 5,173,414 | A | 12/1992 | Lebkowski et al. |
| 5,223,409 | A | 6/1993 | Ladner et al. |

(Continued)

FOREIGN PATENT DOCUMENTS

| AU | 2012354062 A1 | 7/2014 |
| AU | 2015252023 A1 | 11/2015 |

(Continued)

OTHER PUBLICATIONS

Wang et al., Enhanced base editing by co-expression of free uracil DNA glycosylase inhibitor, Published online Aug. 29, 2017, Cell Research, vol. 21, pp. 1289-1292. (Year: 2017).*
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.

(Continued)

*Primary Examiner* — Neil P Hammell
(74) *Attorney, Agent, or Firm* — Wolf, Greenfield & Sacks, P.C.

(57) ABSTRACT

Some aspects of this disclosure provide strategies, systems, reagents, methods, and kits that are useful for the targeted editing of nucleic acids, including editing a single site within the genome of a cell or subject, e.g., within the human genome. In some embodiments, fusion proteins of nucleic acid programmable DNA binding proteins (napDNAbp), e.g., Cpf1 or variants thereof, and nucleic acid editing proteins or protein domains, e.g., deaminase domains, are provided. In some embodiments, methods for targeted nucleic acid editing are provided. In some embodiments, reagents and kits for the generation of targeted nucleic acid editing proteins, e.g., fusion proteins of a napDNAbp (e.g., CasX, CasY, Cpf1, C2c1, C2c2, C2C3, and Argonaute) and nucleic acid editing proteins or domains, are provided.

26 Claims, 208 Drawing Sheets

Specification includes a Sequence Listing.

(56) References Cited

U.S. PATENT DOCUMENTS

| | | |
|---|---|---|
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,658,727 A | 8/1997 | Barbas et al. |
| 5,668,005 A | 9/1997 | Kotewicz et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,851,548 A | 12/1998 | Dattagupta et al. |
| 5,855,910 A | 1/1999 | Ashley et al. |
| 5,962,313 A | 10/1999 | Podsakoff et al. |
| 5,981,182 A | 11/1999 | Jacobs, Jr. et al. |
| 6,057,153 A | 5/2000 | George et al. |
| 6,063,608 A | 5/2000 | Kotewicz et al. |
| 6,156,509 A | 12/2000 | Schellenberger |
| 6,183,998 B1 | 2/2001 | Ivanov et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,078,208 B2 | 7/2006 | Smith et al. |
| 7,163,824 B2 | 1/2007 | Cox, III et al. |
| 7,479,573 B2 | 1/2009 | Chu et al. |
| 7,595,179 B2 | 9/2009 | Chen et al. |
| 7,670,807 B2 | 3/2010 | Lampson et al. |
| 7,794,931 B2 | 9/2010 | Breaker et al. |
| 7,919,277 B2 | 4/2011 | Russell et al. |
| 7,993,672 B2 | 8/2011 | Huang et al. |
| 8,067,556 B2 | 11/2011 | Hogrefe et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,846,578 B2 | 9/2014 | McCray et al. |
| 8,889,418 B2 | 11/2014 | Zhang et al. |
| 8,900,814 B2 | 12/2014 | Yasukawa et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,068,179 B1 | 6/2015 | Liu et al. |
| 9,163,284 B2 | 10/2015 | Liu et al. |
| 9,181,535 B2 | 11/2015 | Liu et al. |
| 9,228,207 B2 | 1/2016 | Liu et al. |
| 9,234,213 B2 | 1/2016 | Wu |
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,458,484 B2 | 10/2016 | Ma et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,534,210 B2 | 1/2017 | Park et al. |
| 9,580,698 B1 | 2/2017 | Xu et al. |
| 9,637,739 B2 | 5/2017 | Siksnys et al. |
| 9,737,604 B2 | 8/2017 | Liu et al. |
| 9,738,693 B2 | 8/2017 | Telford et al. |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,597,679 B2 | 3/2020 | Liu et al. |
| 10,612,011 B2 | 4/2020 | Liu et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0203109 A1 | 10/2004 | Lal et al. |
| 2005/0136429 A1 | 6/2005 | Guarente et al. |
| 2005/0222030 A1 | 10/2005 | Allison |

(56) References Cited

U.S. PATENT DOCUMENTS

| | | |
|---|---|---|
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0264692 A1 | 11/2007 | Liu et al. |
| 2007/0269817 A1 | 11/2007 | Shapero |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273234 A1 | 9/2014 | Zhang et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0275202 A1 | 10/2015 | Liu et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |

(56) References Cited

U.S. PATENT DOCUMENTS

| | | |
|---|---|---|
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0314016 A1 | 11/2017 | Kim et al. |
| 2017/0362635 A1 | 12/2017 | Chamberlain et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237758 A1 | 8/2018 | Liu et al. |
| 2018/0237787 A1 | 8/2018 | Maianti et al. |
| 2018/0245066 A1 | 8/2018 | Yao et al. |
| 2018/0258418 A1 | 9/2018 | Kim |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312835 A1 | 11/2018 | Yao et al. |
| 2018/0327756 A1 | 11/2018 | Zhang et al. |
| 2019/0010481 A1 | 1/2019 | Joung et al. |
| 2019/0055543 A1 | 2/2019 | Tran et al. |
| 2019/0093099 A1 | 3/2019 | Liu et al. |
| 2019/0185883 A1 | 6/2019 | Liu et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2020/0399619 A1 | 12/2020 | Maianti et al. |
| 2021/0054416 A1 | 2/2021 | Liu et al. |
| 2021/0115428 A1 | 4/2021 | Maianti et al. |
| 2021/0196809 A1 | 7/2021 | Liu et al. |
| 2021/0198330 A1 | 7/2021 | Liu et al. |
| 2021/0214698 A1 | 7/2021 | Liu et al. |
| 2021/0230577 A1 | 7/2021 | Liu et al. |

FOREIGN PATENT DOCUMENTS

| | | |
|---|---|---|
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2 852 593 A1 | 11/2015 |
| CN | 1069962 A | 3/1993 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |

(56) References Cited

FOREIGN PATENT DOCUMENTS

| | | |
|---|---|---|
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |

(56) References Cited

FOREIGN PATENT DOCUMENTS

| | | |
|---|---|---|
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 | 1/2018 |

(56) References Cited

FOREIGN PATENT DOCUMENTS

| | | |
|---|---|---|
| CN | 107586777 | 1/2018 |
| CN | 107586779 | 1/2018 |
| CN | 107604003 | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 109 517 841 A | 3/2019 |
| EP | 0264166 A1 | 4/1988 |
| EP | 2 604 255 A1 | 6/2013 |
| EP | 2840140 A1 | 2/2015 |
| EP | 2 966 170 A1 | 1/2016 |
| EP | 3 009 511 A2 | 4/2016 |
| EP | 3031921 A1 | 6/2016 |
| EP | 3045537 A1 | 7/2016 |
| EP | 3115457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| ES | 2740248 T3 | 2/2020 |
| GB | 2 528 177 A | 1/2016 |
| GB | 2531454 A | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-539929 A | 12/2010 |
| JP | 2011-081011 A | 4/2011 |
| JP | 2011-523353 A | 8/2011 |
| JP | 2012-525146 A | 10/2012 |

(56) References Cited

FOREIGN PATENT DOCUMENTS

| | | | |
|---|---|---|---|
| JP | 2012-531909 A | 12/2012 | |
| KR | 101584933 B1 | 1/2016 | |
| KR | 20160133380 A | 11/2016 | |
| KR | 20170037025 A | 4/2017 | |
| KR | 20170037028 A | 4/2017 | |
| KR | 101748575 B1 | 6/2017 | |
| KR | 2018-0022465 A | 3/2018 | |
| RU | 2016104674 A | 8/2017 | |
| RU | 2634395 C1 | 10/2017 | |
| RU | 2652899 C1 | 5/2018 | |
| RU | 2015128057 A | 3/2019 | |
| RU | 2015128098 A | 3/2019 | |
| RU | 2687451 C1 | 5/2019 | |
| RU | 2019112514 A | 6/2019 | |
| RU | 2019127300 A | 9/2019 | |
| RU | 2701850 C2 | 10/2019 | |
| TW | I608100 B | 12/2017 | |
| TW | 2018-29773 A | 8/2018 | |
| WO | WO 90/02809 | 3/1990 | |
| WO | WO 91/16024 A1 | 10/1991 | |
| WO | WO 91/17271 A1 | 11/1991 | |
| WO | WO 91/17424 A1 | 11/1991 | |
| WO | WO 92/06188 A2 | 4/1992 | |
| WO | WO 92/06200 A1 | 4/1992 | |
| WO | WO 93/24641 A2 | 12/1993 | |
| WO | WO 94/18316 A2 | 8/1994 | |
| WO | WO 94/026877 A1 | 11/1994 | |
| WO | WO 96/04403 A1 | 2/1996 | |
| WO | WO 96/10640 A1 | 4/1996 | |
| WO | WO 98/32845 A1 | 7/1998 | |
| WO | WO 2001/036452 A2 | 5/2001 | |
| WO | WO-2001/38547 A2 | 5/2001 | |
| WO | WO-2002/059296 A2 | 8/2002 | |
| WO | WO-2002/068676 A2 | 9/2002 | |
| WO | WO-2002/103028 A2 | 12/2002 | |
| WO | WO-2004/007684 A2 | 1/2004 | |
| WO | WO-2005/014791 A2 | 2/2005 | |
| WO | WO 2005/019415 A2 | 3/2005 | |
| WO | WO-2006/002547 A1 | 1/2006 | |
| WO | WO-2006/042112 A2 | 4/2006 | |
| WO | WO-2007/025097 A2 | 3/2007 | |
| WO | WO 07/066923 A1 | 6/2007 | |
| WO | WO-2007/136815 A2 | 11/2007 | |
| WO | WO-2007/143574 A1 | 12/2007 | |
| WO | WO 08/005529 A2 | 1/2008 | |
| WO | WO-2008/108989 A2 | 9/2008 | |
| WO | WO 2009/098290 A1 | 8/2009 | |
| WO | WO-2009/134808 A2 | 11/2009 | |
| WO | WO-2010/011961 A2 | 1/2010 | |
| WO | WO 2010/028347 A2 | 3/2010 | |
| WO | WO-2010/054108 A2 | 5/2010 | |
| WO | WO-2010/054154 A2 | 5/2010 | |
| WO | WO-2010/068289 A2 | 6/2010 | |
| WO | WO-2010/075424 A2 | 7/2010 | |
| WO | WO-2010/102257 A2 | 9/2010 | |
| WO | WO-2010/129019 A2 | 11/2010 | |
| WO | WO-2010/129023 A2 | 11/2010 | |
| WO | WO-2010/132092 A2 | 11/2010 | |
| WO | WO-2010/144150 A2 | 12/2010 | |
| WO | WO-2011/002503 A1 | 1/2011 | |
| WO | WO-2011/017293 A2 | 2/2011 | |
| WO | WO-2011/053868 A1 | 5/2011 | |
| WO | WO-2011/053982 A2 | 5/2011 | |
| WO | WO 2011/068810 A1 | 6/2011 | |
| WO | WO-2011/075627 A1 | 6/2011 | |
| WO | WO-2011/091311 A2 | 7/2011 | |
| WO | WO-2011/109031 A1 | 9/2011 | |
| WO | WO-2011/143124 A2 | 11/2011 | |
| WO | WO 2011/147590 A2 | 12/2011 | |
| WO | WO 2011/159369 A1 | 12/2011 | |
| WO | WO-2012/054726 A1 | 4/2012 | |
| WO | WO-2012/065043 A2 | 5/2012 | |
| WO | WO 2012/088381 A2 | 6/2012 | |
| WO | WO-2012/125445 A2 | 9/2012 | |
| WO | WO-2012/138927 A2 | 10/2012 | |
| WO | WO 2012/149470 A1 | 11/2012 | |
| WO | WO-2012/158985 A2 | 11/2012 | |
| WO | WO-2012/158986 A2 | 11/2012 | |
| WO | WO-2012/164565 A1 | 12/2012 | |
| WO | WO 2012/170930 A1 | 12/2012 | |
| WO | WO-2013/012674 A1 | 1/2013 | |
| WO | WO-2013/013105 A2 | 1/2013 | |
| WO | WO 2013/039857 A1 | 3/2013 | |
| WO | WO 2013/039861 A2 | 3/2013 | |
| WO | WO 2013/045632 A1 | 4/2013 | |
| WO | WO 2013/047844 A1 | 4/2013 | |
| WO | WO-2013/066438 A2 | 5/2013 | |
| WO | WO 2013/086441 A2 | 6/2013 | |
| WO | WO 2013/086444 A2 | 6/2013 | |
| WO | WO-2013/098244 A1 | 7/2013 | |
| WO | WO-2013/119602 A1 | 8/2013 | |
| WO | WO-2013/126794 A1 | 8/2013 | |
| WO | WO-2013/130824 A1 | 9/2013 | |
| WO | WO-2013/141680 A1 | 9/2013 | |
| WO | WO-2013/142578 A1 | 9/2013 | |
| WO | WO 2013/152359 A1 | 10/2013 | |
| WO | WO-2013/160230 A1 | 10/2013 | |
| WO | WO-2013/166315 A1 | 11/2013 | |
| WO | WO-2013/169398 A2 | 11/2013 | |
| WO | WO-2013/169802 A1 | 11/2013 | |
| WO | WO-2013/176772 A1 | 11/2013 | |
| WO | WO-2013/176915 A1 | 11/2013 | |
| WO | WO-2013/176916 A1 | 11/2013 | |
| WO | WO-2013/181440 A1 | 12/2013 | |
| WO | WO-2013/186754 A2 | 12/2013 | |
| WO | WO-2013/188037 A2 | 12/2013 | |
| WO | WO-2013/188522 A2 | 12/2013 | |
| WO | WO-2013/188638 A2 | 12/2013 | |
| WO | WO-2013/192278 A2 | 12/2013 | |
| WO | WO-2013/142378 A9 | 1/2014 | |
| WO | WO 2014/004336 A2 | 1/2014 | |
| WO | WO-2014/005042 A2 | 1/2014 | |
| WO | WO-2014/011237 A1 | 1/2014 | |
| WO | WO-2014/011901 A2 | 1/2014 | |
| WO | WO-2014/018423 A2 | 1/2014 | |
| WO | WO-2014/020608 A1 | 2/2014 | |
| WO | WO-2014/022120 A1 | 2/2014 | |
| WO | WO-2014/022702 A2 | 2/2014 | |
| WO | WO-2014/036219 A2 | 3/2014 | |
| WO | WO-2014/039513 A2 | 3/2014 | |
| WO | WO-2014/039523 A1 | 3/2014 | |
| WO | WO 2014/039585 A2 | 3/2014 | |
| WO | WO-2014/039684 A1 | 3/2014 | |
| WO | WO-2014/039692 A2 | 3/2014 | |
| WO | WO-2014/039702 A2 | 3/2014 | |
| WO | WO-2014/039872 A1 | 3/2014 | |
| WO | WO-2014/039970 A1 | 3/2014 | |
| WO | WO-2014/041327 A1 | 3/2014 | |
| WO | WO-2014/043143 A1 | 3/2014 | |
| WO | WO-2014/047103 A2 | 3/2014 | |
| WO | WO 2014/055782 A1 | 4/2014 | |
| WO | WO-2014/059173 A2 | 4/2014 | |
| WO | WO-2014/059255 A1 | 4/2014 | |
| WO | WO-2014/065596 A1 | 5/2014 | |
| WO | WO-2014/066505 A1 | 5/2014 | |
| WO | WO-2014/068346 A2 | 5/2014 | |
| WO | WO-2014/070887 A1 | 5/2014 | |
| WO | WO-2014/071006 A1 | 5/2014 | |
| WO | WO-2014/071219 A1 | 5/2014 | |
| WO | WO-2014/071235 A1 | 5/2014 | |
| WO | WO-2014/072941 A1 | 5/2014 | |
| WO | WO-2014/081729 A1 | 5/2014 | |
| WO | WO-2014/081730 A1 | 5/2014 | |
| WO | WO-2014/081855 A1 | 5/2014 | |
| WO | WO-2014/082644 A1 | 6/2014 | |
| WO | WO-2014/085261 A1 | 6/2014 | |
| WO | WO-2014/085593 A1 | 6/2014 | |
| WO | WO-2014/085830 A2 | 6/2014 | |
| WO | WO-2014/089212 A1 | 6/2014 | |
| WO | WO-2014/089290 A1 | 6/2014 | |
| WO | WO-2014/089348 A1 | 6/2014 | |
| WO | WO-2014/089513 A1 | 6/2014 | |
| WO | WO-2014/089533 A2 | 6/2014 | |
| WO | WO-2014/089541 A2 | 6/2014 | |

(56) References Cited

FOREIGN PATENT DOCUMENTS

| | | |
|---|---|---|
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/093736 A1 | 6/2014 |
| WO | WO-2014/093768 A1 | 6/2014 |
| WO | WO-2014/093852 A1 | 6/2014 |
| WO | WO-2014/096972 A2 | 6/2014 |
| WO | WO-2014/099744 A1 | 6/2014 |
| WO | WO-2014/099750 A2 | 6/2014 |
| WO | WO-2014/104878 A1 | 7/2014 |
| WO | WO-2014/110006 A1 | 7/2014 |
| WO | WO-2014/110552 A1 | 7/2014 |
| WO | WO-2014/113493 A1 | 7/2014 |
| WO | WO-2014/123967 A2 | 8/2014 |
| WO | WO-2014/124226 A1 | 8/2014 |
| WO | WO-2014/125668 A1 | 8/2014 |
| WO | WO-2014/127287 A1 | 8/2014 |
| WO | WO-2014/128324 A1 | 8/2014 |
| WO | WO-2014/128659 A1 | 8/2014 |
| WO | WO-2014/130706 A1 | 8/2014 |
| WO | WO-2014/130955 A1 | 8/2014 |
| WO | WO-2014/131833 A1 | 9/2014 |
| WO | WO-2014/138379 A1 | 9/2014 |
| WO | WO-2014/143381 A1 | 9/2014 |
| WO | WO-2014/144094 A1 | 9/2014 |
| WO | WO-2014/144155 A1 | 9/2014 |
| WO | WO-2014/144288 A1 | 9/2014 |
| WO | WO-2014/144592 A2 | 9/2014 |
| WO | WO-2014/144761 A2 | 9/2014 |
| WO | WO-2014/144951 A1 | 9/2014 |
| WO | WO-2014/145599 A2 | 9/2014 |
| WO | WO-2014/145736 A2 | 9/2014 |
| WO | WO-2014/150624 A1 | 9/2014 |
| WO | WO-2014/152432 A2 | 9/2014 |
| WO | WO 2014/152940 A1 | 9/2014 |
| WO | WO-2014/153118 A1 | 9/2014 |
| WO | WO-2014/153470 A2 | 9/2014 |
| WO | WO 2014/158593 A1 | 10/2014 |
| WO | WO-2014/161821 A1 | 10/2014 |
| WO | WO-2014/164466 A1 | 10/2014 |
| WO | WO-2014/165177 A1 | 10/2014 |
| WO | WO-2014/165349 A1 | 10/2014 |
| WO | WO-2014/165612 A2 | 10/2014 |
| WO | WO-2014/165707 A2 | 10/2014 |
| WO | WO-2014/165825 A2 | 10/2014 |
| WO | WO-2014/172458 A1 | 10/2014 |
| WO | WO-2014/172470 A2 | 10/2014 |
| WO | WO-2014/172489 A2 | 10/2014 |
| WO | WO-2014/173955 A1 | 10/2014 |
| WO | WO-2014/182700 A1 | 11/2014 |
| WO | WO-2014/183071 A2 | 11/2014 |
| WO | WO-2014/184143 A1 | 11/2014 |
| WO | WO-2014/184741 A1 | 11/2014 |
| WO | WO-2014/184744 A1 | 11/2014 |
| WO | WO-2014/186585 A2 | 11/2014 |
| WO | WO-2014/186686 A2 | 11/2014 |
| WO | WO-2014/190181 A1 | 11/2014 |
| WO | WO-2014/191128 A1 | 12/2014 |
| WO | WO-2014/191518 A1 | 12/2014 |
| WO | WO-2014/191521 A2 | 12/2014 |
| WO | WO-2014/191525 A1 | 12/2014 |
| WO | WO-2014/191527 A1 | 12/2014 |
| WO | WO-2014/193583 A2 | 12/2014 |
| WO | WO-2014/194190 A1 | 12/2014 |
| WO | WO-2014/197568 A2 | 12/2014 |
| WO | WO-2014/199358 A1 | 12/2014 |
| WO | WO-2014/200659 A1 | 12/2014 |
| WO | WO-2014/201015 A2 | 12/2014 |
| WO | WO-2014/204578 A1 | 12/2014 |
| WO | WO-2014/204723 A1 | 12/2014 |
| WO | WO-2014/204724 A1 | 12/2014 |
| WO | WO-2014/204725 A1 | 12/2014 |
| WO | WO-2014/204726 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | WO-2014/205192 A2 | 12/2014 |
| WO | WO-2014/207043 A1 | 12/2014 |
| WO | WO-2014197748 A2 | 12/2014 |
| WO | WO-2015/002780 A1 | 1/2015 |
| WO | WO-2015/004241 A2 | 1/2015 |
| WO | WO-2015/006290 A1 | 1/2015 |
| WO | WO-2015/006294 A2 | 1/2015 |
| WO | WO-2015/006437 A1 | 1/2015 |
| WO | WO-2015/006498 A2 | 1/2015 |
| WO | WO-2015/007194 A1 | 1/2015 |
| WO | WO-2015/010114 A1 | 1/2015 |
| WO | WO-2015/011483 A1 | 1/2015 |
| WO | WO-2015/013583 A2 | 1/2015 |
| WO | WO-2015006747 A2 | 1/2015 |
| WO | WO-2015/017866 A1 | 2/2015 |
| WO | WO-2015/018503 A1 | 2/2015 |
| WO | WO-2015/021353 A1 | 2/2015 |
| WO | WO-2015/021426 A1 | 2/2015 |
| WO | WO-2015/021990 A1 | 2/2015 |
| WO | WO-2015/024017 A2 | 2/2015 |
| WO | WO-2015/024986 A1 | 2/2015 |
| WO | WO-2015/026883 A1 | 2/2015 |
| WO | WO-2015/026885 A1 | 2/2015 |
| WO | WO-2015/026886 A1 | 2/2015 |
| WO | WO-2015/026887 A1 | 2/2015 |
| WO | WO-2015/027134 A1 | 2/2015 |
| WO | WO-2015/028969 A2 | 3/2015 |
| WO | WO-2015/030881 A1 | 3/2015 |
| WO | WO-2015/031619 A1 | 3/2015 |
| WO | WO-2015/031775 A1 | 3/2015 |
| WO | WO-2015/032494 A2 | 3/2015 |
| WO | WO-2015/033293 A1 | 3/2015 |
| WO | WO-2015/034872 A2 | 3/2015 |
| WO | WO-2015/034885 A1 | 3/2015 |
| WO | WO-2015/035136 A2 | 3/2015 |
| WO | WO-2015/035139 A2 | 3/2015 |
| WO | WO-2015/035162 A2 | 3/2015 |
| WO | WO-2015/040075 A1 | 3/2015 |
| WO | WO-2015/040402 A1 | 3/2015 |
| WO | WO-2015/042585 A1 | 3/2015 |
| WO | WO-2015/048577 A2 | 4/2015 |
| WO | WO-2015/048690 A1 | 4/2015 |
| WO | WO-2015/048707 A2 | 4/2015 |
| WO | WO-2015/048801 A2 | 4/2015 |
| WO | WO-2015/049897 A1 | 4/2015 |
| WO | WO-2015/051191 A1 | 4/2015 |
| WO | WO-2015/052133 A1 | 4/2015 |
| WO | WO-2015/052231 A2 | 4/2015 |
| WO | WO-2015/052335 A1 | 4/2015 |
| WO | WO-2015/053995 A1 | 4/2015 |
| WO | WO-2015/054253 A1 | 4/2015 |
| WO | WO-2015/054315 A1 | 4/2015 |
| WO | WO-2015/057671 A1 | 4/2015 |
| WO | WO-2015/057834 A1 | 4/2015 |
| WO | WO-2015/057852 A1 | 4/2015 |
| WO | WO-2015/057976 A1 | 4/2015 |
| WO | WO-2015/057980 A1 | 4/2015 |
| WO | WO-2015/059265 A1 | 4/2015 |
| WO | WO-2015/065964 A1 | 5/2015 |
| WO | WO-2015/066119 A1 | 5/2015 |
| WO | WO-2015/066634 A2 | 5/2015 |
| WO | WO-2015/066636 A2 | 5/2015 |
| WO | WO-2015/066637 A1 | 5/2015 |
| WO | WO-2015/066638 A2 | 5/2015 |
| WO | WO-2015/066643 A1 | 5/2015 |
| WO | WO-2015/069682 A2 | 5/2015 |
| WO | WO-2015/070083 A1 | 5/2015 |
| WO | WO-2015/070193 A1 | 5/2015 |
| WO | WO-2015/070212 A1 | 5/2015 |
| WO | WO-2015/071474 A2 | 5/2015 |

(56) References Cited

FOREIGN PATENT DOCUMENTS

| | | |
|---|---|---|
| WO | WO-2015/073683 A2 | 5/2015 |
| WO | WO-2015/073867 A1 | 5/2015 |
| WO | WO-2015/073990 A1 | 5/2015 |
| WO | WO-2015/075056 A1 | 5/2015 |
| WO | WO-2015/075154 A2 | 5/2015 |
| WO | WO-2015/075175 A1 | 5/2015 |
| WO | WO-2015/075195 A1 | 5/2015 |
| WO | WO-2015/075557 A2 | 5/2015 |
| WO | WO-2015/077058 A2 | 5/2015 |
| WO | WO-2015/077290 A2 | 5/2015 |
| WO | WO-2015/077318 A1 | 5/2015 |
| WO | WO-2015/079056 A1 | 6/2015 |
| WO | WO-2015/079057 A2 | 6/2015 |
| WO | WO-2015/086795 A1 | 6/2015 |
| WO | WO-2015/086798 A2 | 6/2015 |
| WO | WO-2015/088643 A1 | 6/2015 |
| WO | WO-2015/089046 A1 | 6/2015 |
| WO | WO-2015/089077 A2 | 6/2015 |
| WO | WO-2015/089277 A1 | 6/2015 |
| WO | WO-2015/089351 A1 | 6/2015 |
| WO | WO-2015/089354 A1 | 6/2015 |
| WO | WO-2015/089364 A1 | 6/2015 |
| WO | WO-2015/089406 A1 | 6/2015 |
| WO | WO-2015/089419 A2 | 6/2015 |
| WO | WO-2015/089427 A1 | 6/2015 |
| WO | WO-2015/089462 A1 | 6/2015 |
| WO | WO-2015/089465 A1 | 6/2015 |
| WO | WO-2015/089473 A1 | 6/2015 |
| WO | WO-2015/089486 A2 | 6/2015 |
| WO | WO-2015/095804 A1 | 6/2015 |
| WO | WO-2015/099850 A1 | 7/2015 |
| WO | WO-2015/100929 A1 | 7/2015 |
| WO | WO-2015/103057 A1 | 7/2015 |
| WO | WO-2015/103153 A1 | 7/2015 |
| WO | WO-2015/105928 A1 | 7/2015 |
| WO | WO-2015/108993 A1 | 7/2015 |
| WO | WO-2015/109752 A1 | 7/2015 |
| WO | WO-2015/110474 A1 | 7/2015 |
| WO | WO-2015/112790 A2 | 7/2015 |
| WO | WO-2015/112896 A2 | 7/2015 |
| WO | WO-2015/113063 A1 | 7/2015 |
| WO | WO-2015/114365 A1 | 8/2015 |
| WO | WO-2015/115903 A1 | 8/2015 |
| WO | WO-2015/116686 A1 | 8/2015 |
| WO | WO-2015/116969 A2 | 8/2015 |
| WO | WO-2015/117021 A1 | 8/2015 |
| WO | WO-2015/117041 A1 | 8/2015 |
| WO | WO-2015/117081 A2 | 8/2015 |
| WO | WO-2015/118156 A1 | 8/2015 |
| WO | WO-2015/119941 A2 | 8/2015 |
| WO | WO-2015/121454 A1 | 8/2015 |
| WO | WO-2015/122967 A1 | 8/2015 |
| WO | WO-2015/123339 A1 | 8/2015 |
| WO | WO-2015/124715 A1 | 8/2015 |
| WO | WO-2015/124718 A1 | 8/2015 |
| WO | WO-2015/126927 A2 | 8/2015 |
| WO | WO-2015/127428 A1 | 8/2015 |
| WO | WO-2015/127439 A1 | 8/2015 |
| WO | WO-2015/129686 A1 | 9/2015 |
| WO | WO-2015/131101 A1 | 9/2015 |
| WO | WO-2015/133554 A1 | 9/2015 |
| WO | WO 2015/134121 A2 | 9/2015 |
| WO | WO-2015/134812 A1 | 9/2015 |
| WO | WO-2015/136001 A1 | 9/2015 |
| WO | WO-2015/138510 A1 | 9/2015 |
| WO | WO-2015/138739 A2 | 9/2015 |
| WO | WO-2015/138855 A1 | 9/2015 |
| WO | WO-2015/138870 A2 | 9/2015 |
| WO | WO-2015/139008 A1 | 9/2015 |
| WO | WO-2015/139139 A1 | 9/2015 |
| WO | WO-2015/143046 A2 | 9/2015 |
| WO | WO-2015/143177 A1 | 9/2015 |
| WO | WO-2015/145417 A1 | 10/2015 |
| WO | WO-2015/148431 A1 | 10/2015 |
| WO | WO-2015/148670 A1 | 10/2015 |
| WO | WO-2015/148680 A1 | 10/2015 |
| WO | WO-2015/148761 A1 | 10/2015 |
| WO | WO-2015/148860 A1 | 10/2015 |
| WO | WO-2015/148863 A2 | 10/2015 |
| WO | WO-2015/153760 A2 | 10/2015 |
| WO | WO-2015/153780 A1 | 10/2015 |
| WO | WO-2015/153789 A1 | 10/2015 |
| WO | WO-2015/153791 A1 | 10/2015 |
| WO | WO-2015/153889 A2 | 10/2015 |
| WO | WO-2015/153940 A1 | 10/2015 |
| WO | WO-2015/155341 A1 | 10/2015 |
| WO | WO-2015/155686 A2 | 10/2015 |
| WO | WO-2015/157070 A2 | 10/2015 |
| WO | WO-2015/157534 A1 | 10/2015 |
| WO | WO-2015/159068 A1 | 10/2015 |
| WO | WO-2015/159086 A1 | 10/2015 |
| WO | WO-2015/159087 A1 | 10/2015 |
| WO | WO-2015/160683 A1 | 10/2015 |
| WO | WO-2015/161276 A2 | 10/2015 |
| WO | WO-2015/163733 A1 | 10/2015 |
| WO | WO-2015/164740 A1 | 10/2015 |
| WO | WO-2015/164748 A1 | 10/2015 |
| WO | WO-2015/165274 A1 | 11/2015 |
| WO | WO-2015/165275 A1 | 11/2015 |
| WO | WO-2015/165276 A1 | 11/2015 |
| WO | WO-2015/166272 A2 | 11/2015 |
| WO | WO-2015/167766 A1 | 11/2015 |
| WO | WO-2015/167956 A1 | 11/2015 |
| WO | WO-2015/168125 A1 | 11/2015 |
| WO | WO-2015/168158 A1 | 11/2015 |
| WO | WO-2015/168404 A1 | 11/2015 |
| WO | WO-2015/168547 A2 | 11/2015 |
| WO | WO-2015/168800 A1 | 11/2015 |
| WO | WO-2015/171603 A1 | 11/2015 |
| WO | WO-2015/171894 A1 | 11/2015 |
| WO | WO-2015/171932 A1 | 11/2015 |
| WO | WO-2015/172128 A1 | 11/2015 |
| WO | WO-2015/173436 A1 | 11/2015 |
| WO | WO-2015/175642 A2 | 11/2015 |
| WO | WO-2015/179540 A1 | 11/2015 |
| WO | WO-2015/183025 A1 | 12/2015 |
| WO | WO-2015/183026 A1 | 12/2015 |
| WO | WO-2015/183885 A1 | 12/2015 |
| WO | WO-2015/184259 A1 | 12/2015 |
| WO | WO-2015/184262 A1 | 12/2015 |
| WO | WO-2015/184268 A1 | 12/2015 |
| WO | WO-2015/188056 A1 | 12/2015 |
| WO | WO-2015/188065 A1 | 12/2015 |
| WO | WO-2015/188094 A1 | 12/2015 |
| WO | WO-2015/188109 A1 | 12/2015 |
| WO | WO-2015/188132 A1 | 12/2015 |
| WO | WO-2015/188135 A1 | 12/2015 |
| WO | WO-2015/188191 A1 | 12/2015 |
| WO | WO-2015/189693 A1 | 12/2015 |
| WO | WO-2015/191693 A2 | 12/2015 |
| WO | WO-2015/191899 A1 | 12/2015 |
| WO | WO-2015/191911 A2 | 12/2015 |
| WO | WO-2015/193858 A1 | 12/2015 |
| WO | WO-2015/195547 A1 | 12/2015 |
| WO | WO-2015/195621 A1 | 12/2015 |
| WO | WO-2015/195798 A1 | 12/2015 |
| WO | WO-2015/198020 A1 | 12/2015 |
| WO | WO-2015/200334 A1 | 12/2015 |
| WO | WO-2015/200378 A1 | 12/2015 |
| WO | WO-2015/200555 A2 | 12/2015 |
| WO | WO-2015/200805 A2 | 12/2015 |
| WO | WO-2016/001978 A1 | 1/2016 |
| WO | WO-2016/004010 A1 | 1/2016 |
| WO | WO 2016/004318 A1 | 1/2016 |
| WO | WO-2016/007347 A1 | 1/2016 |
| WO | WO-2016/007604 A1 | 1/2016 |
| WO | WO-2016/007948 A1 | 1/2016 |
| WO | WO-2016/011080 A2 | 1/2016 |
| WO | WO-2016/011210 A2 | 1/2016 |
| WO | WO-2016/011428 A1 | 1/2016 |
| WO | WO-2016/012544 A2 | 1/2016 |
| WO | WO-2016/012552 A1 | 1/2016 |
| WO | WO-2016/014409 A1 | 1/2016 |
| WO | WO-2016/014565 A2 | 1/2016 |

(56) References Cited

FOREIGN PATENT DOCUMENTS

| | | |
|---|---|---|
| WO | WO-2016/014794 A1 | 1/2016 |
| WO | WO-2016/014837 A1 | 1/2016 |
| WO | WO-2016/016119 A1 | 2/2016 |
| WO | WO-2016/016358 A1 | 2/2016 |
| WO | WO-2016/019144 A2 | 2/2016 |
| WO | WO-2016/020399 A1 | 2/2016 |
| WO | WO-2016/021972 A1 | 2/2016 |
| WO | WO-2016/021973 A1 | 2/2016 |
| WO | WO-2016/022363 A2 | 2/2016 |
| WO | WO-2016/022866 A1 | 2/2016 |
| WO | WO-2016/022931 A1 | 2/2016 |
| WO | WO-2016/025131 A1 | 2/2016 |
| WO | WO-2016/025469 A1 | 2/2016 |
| WO | WO-2016/025759 A1 | 2/2016 |
| WO | WO-2016/026444 A1 | 2/2016 |
| WO | WO-2016/028682 A1 | 2/2016 |
| WO | WO-2016/028843 A2 | 2/2016 |
| WO | WO-2016/028887 A1 | 2/2016 |
| WO | WO-2016/033088 A1 | 3/2016 |
| WO | WO-2016/033230 A1 | 3/2016 |
| WO | WO-2016/033246 A1 | 3/2016 |
| WO | WO-2016/033298 A1 | 3/2016 |
| WO | WO-2016/035044 A1 | 3/2016 |
| WO | WO-2016/036754 A1 | 3/2016 |
| WO | WO-2016/037157 A2 | 3/2016 |
| WO | WO-2016/040030 A1 | 3/2016 |
| WO | WO-2016/040594 A1 | 3/2016 |
| WO | WO-2016/044182 A1 | 3/2016 |
| WO | WO-2016/044416 A1 | 3/2016 |
| WO | WO-2016/046635 A1 | 3/2016 |
| WO | WO-2016/049024 A2 | 3/2016 |
| WO | WO-2016/049163 A2 | 3/2016 |
| WO | WO-2016/049230 A1 | 3/2016 |
| WO | WO-2016/049251 A1 | 3/2016 |
| WO | WO-2016/049258 A2 | 3/2016 |
| WO | WO-2016/053397 A2 | 4/2016 |
| WO | WO-2016/054326 A1 | 4/2016 |
| WO | WO-2016/057061 A2 | 4/2016 |
| WO | WO-2016/057821 A2 | 4/2016 |
| WO | WO-2016/057835 A2 | 4/2016 |
| WO | WO-2016/057850 A1 | 4/2016 |
| WO | WO-2016/057951 A2 | 4/2016 |
| WO | WO-2016/057961 A1 | 4/2016 |
| WO | WO-2016/061073 A1 | 4/2016 |
| WO | WO-2016/061374 A1 | 4/2016 |
| WO | WO-2016/061481 A1 | 4/2016 |
| WO | WO-2016/061523 A1 | 4/2016 |
| WO | WO-2016/064894 A2 | 4/2016 |
| WO | WO-2016/069282 A1 | 5/2016 |
| WO | WO-2016/069283 A1 | 5/2016 |
| WO | WO-2016/069591 A2 | 5/2016 |
| WO | WO 2016/069774 A1 | 5/2016 |
| WO | WO-2016/069910 A1 | 5/2016 |
| WO | WO-2016/069912 A1 | 5/2016 |
| WO | WO-2016/070037 A2 | 5/2016 |
| WO | WO-2016/070070 A1 | 5/2016 |
| WO | WO-2016/070129 A1 | 5/2016 |
| WO | WO-2016/072399 A1 | 5/2016 |
| WO | WO-2016/072936 A1 | 5/2016 |
| WO | WO-2016/073433 A1 | 5/2016 |
| WO | WO-2016/073559 A1 | 5/2016 |
| WO | WO-2016/073990 A2 | 5/2016 |
| WO | WO-2016/075662 A2 | 5/2016 |
| WO | WO-2016/076672 A1 | 5/2016 |
| WO | WO-2016/077273 A1 | 5/2016 |
| WO | WO-2016/077350 A1 | 5/2016 |
| WO | WO-2016/080097 A1 | 5/2016 |
| WO | WO-2016/080795 A1 | 5/2016 |
| WO | WO-2016/081923 A2 | 5/2016 |
| WO | WO-2016/081924 A1 | 5/2016 |
| WO | WO-2016/082135 A1 | 6/2016 |
| WO | WO-2016/083811 A1 | 6/2016 |
| WO | WO-2016/084084 A1 | 6/2016 |
| WO | WO-2016/084088 A1 | 6/2016 |
| WO | WO-2016/086177 A2 | 6/2016 |
| WO | WO-2016/089433 A1 | 6/2016 |
| WO | WO-2016/089866 A1 | 6/2016 |
| WO | WO-2016/089883 A1 | 6/2016 |
| WO | WO-2016/090385 A1 | 6/2016 |
| WO | WO-2016/094679 A1 | 6/2016 |
| WO | WO-2016/094845 A2 | 6/2016 |
| WO | WO-2016/094867 A1 | 6/2016 |
| WO | WO-2016/094872 A1 | 6/2016 |
| WO | WO-2016/094874 A1 | 6/2016 |
| WO | WO-2016/094880 A1 | 6/2016 |
| WO | WO-2016/094888 A1 | 6/2016 |
| WO | WO-2016/097212 A1 | 6/2016 |
| WO | WO-2016/097231 A2 | 6/2016 |
| WO | WO-2016/097751 A1 | 6/2016 |
| WO | WO-2016/099887 A1 | 6/2016 |
| WO | WO-2016/100272 A1 | 6/2016 |
| WO | WO-2016/100389 A1 | 6/2016 |
| WO | WO-2016/100568 A1 | 6/2016 |
| WO | WO-2016/100571 A1 | 6/2016 |
| WO | WO-2016/100951 A2 | 6/2016 |
| WO | WO-2016/100955 A2 | 6/2016 |
| WO | WO-2016/100974 A1 | 6/2016 |
| WO | WO-2016/103233 A2 | 6/2016 |
| WO | WO-2016/104716 A1 | 6/2016 |
| WO | WO-2016/106236 A1 | 6/2016 |
| WO | WO-2016/106239 A1 | 6/2016 |
| WO | WO-2016/106244 A1 | 6/2016 |
| WO | WO-2016/106338 A2 | 6/2016 |
| WO | WO-2016/108926 A1 | 7/2016 |
| WO | WO-2016/109255 A1 | 7/2016 |
| WO | WO-2016/109840 A2 | 7/2016 |
| WO | WO-2016/110214 A1 | 7/2016 |
| WO | WO-2016/110453 A1 | 7/2016 |
| WO | WO-2016/110511 A1 | 7/2016 |
| WO | WO-2016/110512 A1 | 7/2016 |
| WO | WO-2016/111546 A2 | 7/2016 |
| WO | WO-2016/112242 A1 | 7/2016 |
| WO | WO-2016/112351 A1 | 7/2016 |
| WO | WO-2016/112963 A1 | 7/2016 |
| WO | WO 2016/113357 A1 | 7/2016 |
| WO | WO-2016/114972 A1 | 7/2016 |
| WO | WO-2016/115179 A1 | 7/2016 |
| WO | WO-2016/115326 A1 | 7/2016 |
| WO | WO-2016/115355 A1 | 7/2016 |
| WO | WO-2016/116032 A1 | 7/2016 |
| WO | WO-2016/120480 A1 | 8/2016 |
| WO | WO-2016/123071 A1 | 8/2016 |
| WO | WO-2016/123230 A1 | 8/2016 |
| WO | WO-2016/123243 A1 | 8/2016 |
| WO | WO-2016/123578 A1 | 8/2016 |
| WO | WO 2016/126747 A1 | 8/2016 |
| WO | WO-2016/130600 A2 | 8/2016 |
| WO | WO-2016/130697 A1 | 8/2016 |
| WO | WO-2016/131009 A1 | 8/2016 |
| WO | WO-2016/132122 A1 | 8/2016 |
| WO | WO-2016/133165 A1 | 8/2016 |
| WO | WO-2016/135507 A1 | 9/2016 |
| WO | WO-2016/135557 A2 | 9/2016 |
| WO | WO-2016/135558 A2 | 9/2016 |
| WO | WO-2016/135559 A2 | 9/2016 |
| WO | WO-2016/137774 A1 | 9/2016 |
| WO | WO-2016/137949 A1 | 9/2016 |
| WO | WO-2016/141224 A1 | 9/2016 |
| WO | WO-2016/141893 A1 | 9/2016 |
| WO | WO-2016/142719 A1 | 9/2016 |
| WO | WO-2016/145150 A2 | 9/2016 |
| WO | WO-2016/148994 A1 | 9/2016 |
| WO | WO-2016/149484 A2 | 9/2016 |
| WO | WO-2016/149547 A1 | 9/2016 |
| WO | WO-2016/150336 A1 | 9/2016 |
| WO | WO-2016/150855 A1 | 9/2016 |
| WO | WO-2016/154016 A2 | 9/2016 |
| WO | WO-2016/154579 A2 | 9/2016 |
| WO | WO-2016/154596 A1 | 9/2016 |
| WO | WO-2016/155482 A1 | 10/2016 |
| WO | WO-2016/161004 A1 | 10/2016 |
| WO | WO-2016/161207 A1 | 10/2016 |
| WO | WO-2016/161260 A1 | 10/2016 |
| WO | WO-2016/161380 A1 | 10/2016 |

(56) References Cited

FOREIGN PATENT DOCUMENTS

| | | |
|---|---|---|
| WO | WO-2016/161446 A1 | 10/2016 |
| WO | WO-2016/164356 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO 2016/168631 A1 | 10/2016 |
| WO | WO-2016/170484 A1 | 10/2016 |
| WO | WO-2016/172359 A2 | 10/2016 |
| WO | WO-2016/172727 A1 | 10/2016 |
| WO | WO-2016/174056 A1 | 11/2016 |
| WO | WO-2016/174151 A1 | 11/2016 |
| WO | WO-2016/174250 A1 | 11/2016 |
| WO | WO-2016/176191 A1 | 11/2016 |
| WO | WO-2016/176404 A1 | 11/2016 |
| WO | WO-2016/176690 A2 | 11/2016 |
| WO | WO-2016/177682 A1 | 11/2016 |
| WO | WO-2016/178207 A1 | 11/2016 |
| WO | WO-2016/179038 A1 | 11/2016 |
| WO | WO-2016/179112 A1 | 11/2016 |
| WO | WO-2016/181357 A1 | 11/2016 |
| WO | WO-2016/182893 A1 | 11/2016 |
| WO | WO-2016/182917 A1 | 11/2016 |
| WO | WO-2016/182959 A1 | 11/2016 |
| WO | WO-2016/183236 A1 | 11/2016 |
| WO | WO-2016/183298 A2 | 11/2016 |
| WO | WO-2016/183345 A1 | 11/2016 |
| WO | WO-2016/183402 A2 | 11/2016 |
| WO | WO-2016/183438 A1 | 11/2016 |
| WO | WO-2016/183448 A1 | 11/2016 |
| WO | WO-2016/184955 A2 | 11/2016 |
| WO | WO-2016/184989 A1 | 11/2016 |
| WO | WO-2016/185411 A1 | 11/2016 |
| WO | WO-2016/186745 A1 | 11/2016 |
| WO | WO-2016/186772 A2 | 11/2016 |
| WO | WO-2016/186946 A1 | 11/2016 |
| WO | WO-2016/186953 A1 | 11/2016 |
| WO | WO-2016/187717 A1 | 12/2016 |
| WO | WO-2016/187904 A1 | 12/2016 |
| WO | WO-2016/191684 A1 | 12/2016 |
| WO | WO-2016/191869 A1 | 12/2016 |
| WO | WO-2016/196273 A1 | 12/2016 |
| WO | WO-2016/196282 A1 | 12/2016 |
| WO | WO-2016/196308 A1 | 12/2016 |
| WO | WO-2016/196361 A1 | 12/2016 |
| WO | WO-2016/196499 A1 | 12/2016 |
| WO | WO-2016/196539 A2 | 12/2016 |
| WO | WO-2016/196655 A1 | 12/2016 |
| WO | WO-2016/196805 A1 | 12/2016 |
| WO | WO-2016/196887 A1 | 12/2016 |
| WO | WO-2016/197132 A1 | 12/2016 |
| WO | WO-2016/197133 A1 | 12/2016 |
| WO | WO-2016/197354 A1 | 12/2016 |
| WO | WO-2016/197355 A1 | 12/2016 |
| WO | WO-2016/197356 A1 | 12/2016 |
| WO | WO-2016/197357 A1 | 12/2016 |
| WO | WO-2016/197358 A1 | 12/2016 |
| WO | WO-2016/197359 A1 | 12/2016 |
| WO | WO-2016/197360 A1 | 12/2016 |
| WO | WO-2016/197361 A1 | 12/2016 |
| WO | WO-2016/197362 A1 | 12/2016 |
| WO | WO-2016/198361 A1 | 12/2016 |
| WO | WO-2016/198500 A1 | 12/2016 |
| WO | WO-2016/200263 A1 | 12/2016 |
| WO | WO-2016/201047 A1 | 12/2016 |
| WO | WO-2016/201138 A1 | 12/2016 |
| WO | WO-2016/201152 A1 | 12/2016 |
| WO | WO-2016/201153 A1 | 12/2016 |
| WO | WO-2016/201155 A1 | 12/2016 |
| WO | WO-2016/205276 A1 | 12/2016 |
| WO | WO-2016/205613 A1 | 12/2016 |
| WO | WO-2016/205623 A1 | 12/2016 |
| WO | WO-2016/205680 A1 | 12/2016 |
| WO | WO-2016/205688 A2 | 12/2016 |
| WO | WO-2016/205703 A1 | 12/2016 |
| WO | WO-2016/205711 A1 | 12/2016 |
| WO | WO-2016/205728 A1 | 12/2016 |
| WO | WO-2016/205745 A2 | 12/2016 |
| WO | WO-2016/205749 A1 | 12/2016 |
| WO | WO-2016/205759 A1 | 12/2016 |
| WO | WO-2016/205764 A1 | 12/2016 |
| WO | WO-2017/001572 A1 | 1/2017 |
| WO | WO-2017/001988 A1 | 1/2017 |
| WO | WO-2017/004261 A1 | 1/2017 |
| WO | WO-2017/004279 A2 | 1/2017 |
| WO | WO-2017/004616 A1 | 1/2017 |
| WO | WO-2017/005807 A1 | 1/2017 |
| WO | WO-2017/009399 A1 | 1/2017 |
| WO | WO-2017/010556 A1 | 1/2017 |
| WO | WO-2017/011519 A1 | 1/2017 |
| WO | WO-2017/011721 A1 | 1/2017 |
| WO | WO-2017/011804 A1 | 1/2017 |
| WO | WO-2017/015015 A1 | 1/2017 |
| WO | WO-2017/015101 A1 | 1/2017 |
| WO | WO 2017/015545 A1 | 1/2017 |
| WO | WO-2017/015567 A1 | 1/2017 |
| WO | WO-2017/015637 A1 | 1/2017 |
| WO | WO-2017/017016 A1 | 2/2017 |
| WO | WO-2017/019867 A1 | 2/2017 |
| WO | WO-2017/019895 A1 | 2/2017 |
| WO | WO-2017/023803 A1 | 2/2017 |
| WO | WO-2017/023974 A1 | 2/2017 |
| WO | WO-2017/024047 A1 | 2/2017 |
| WO | WO-2017/024319 A1 | 2/2017 |
| WO | WO-2017/024343 A1 | 2/2017 |
| WO | WO-2017/024602 A1 | 2/2017 |
| WO | WO-2017/025323 A1 | 2/2017 |
| WO | WO-2017/027423 A1 | 2/2017 |
| WO | WO-2017/028768 A1 | 2/2017 |
| WO | WO-2017/029664 A1 | 2/2017 |
| WO | WO-2017/031360 A1 | 2/2017 |
| WO | WO-2017/031483 A1 | 2/2017 |
| WO | WO-2017/035416 A2 | 3/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/040786 A1 | 3/2017 |
| WO | WO-2017/040793 A1 | 3/2017 |
| WO | WO-2017/040813 A2 | 3/2017 |
| WO | WO-2017/043573 A1 | 3/2017 |
| WO | WO-2017/043656 A1 | 3/2017 |
| WO | WO-2017/044419 A1 | 3/2017 |
| WO | WO-2017/044776 A1 | 3/2017 |
| WO | WO-2017/044857 A2 | 3/2017 |
| WO | WO 2017/048390 A1 | 3/2017 |
| WO | WO-2017/049129 A2 | 3/2017 |
| WO | WO-2017/050963 A1 | 3/2017 |
| WO | WO-2017/053312 A1 | 3/2017 |
| WO | WO-2017/053431 A2 | 3/2017 |
| WO | WO-2017/053713 A1 | 3/2017 |
| WO | WO-2017/053729 A1 | 3/2017 |
| WO | WO-2017/053753 A1 | 3/2017 |
| WO | WO-2017/053762 A1 | 3/2017 |
| WO | WO-2017/053879 A1 | 3/2017 |
| WO | WO 2017/054721 A1 | 4/2017 |
| WO | WO-2017/058658 A2 | 4/2017 |
| WO | WO 2017/059241 A1 | 4/2017 |
| WO | WO-2017/062605 A1 | 4/2017 |
| WO | WO-2017/062723 A1 | 4/2017 |
| WO | WO-2017/062754 A1 | 4/2017 |
| WO | WO-2017/062855 A1 | 4/2017 |
| WO | WO-2017/062886 A1 | 4/2017 |
| WO | WO-2017/062983 A1 | 4/2017 |
| WO | WO-2017/064439 A1 | 4/2017 |
| WO | WO-2017/064546 A1 | 4/2017 |
| WO | WO-2017/064566 A2 | 4/2017 |
| WO | WO-2017/066175 A1 | 4/2017 |
| WO | WO-2017/066497 A2 | 4/2017 |
| WO | WO-2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO-2017/068377 A1 | 4/2017 |
| WO | WO-2017/069829 A2 | 4/2017 |
| WO | WO-2017/070029 A1 | 4/2017 |

(56) References Cited

FOREIGN PATENT DOCUMENTS

| | | |
|---|---|---|
| WO | WO-2017/070032 A1 | 4/2017 |
| WO | WO-2017/070169 A1 | 4/2017 |
| WO | WO-2017/070284 A1 | 4/2017 |
| WO | WO-2017/070598 A1 | 4/2017 |
| WO | WO-2017/070605 A1 | 4/2017 |
| WO | WO-2017/070632 A2 | 4/2017 |
| WO | WO-2017/070633 A2 | 4/2017 |
| WO | WO-2017/072590 A1 | 5/2017 |
| WO | WO-2017/074526 A1 | 5/2017 |
| WO | WO-2017/074962 A1 | 5/2017 |
| WO | WO-2017/075261 A1 | 5/2017 |
| WO | WO 2017/075335 A1 | 5/2017 |
| WO | WO-2017/075475 A1 | 5/2017 |
| WO | WO-2017/077135 A1 | 5/2017 |
| WO | WO-2017/077329 A2 | 5/2017 |
| WO | WO-2017/078751 A1 | 5/2017 |
| WO | WO-2017/079400 A1 | 5/2017 |
| WO | WO-2017/079428 A1 | 5/2017 |
| WO | WO-2017/079673 A1 | 5/2017 |
| WO | WO-2017/079724 A1 | 5/2017 |
| WO | WO-2017/081097 A1 | 5/2017 |
| WO | WO-2017/081288 A1 | 5/2017 |
| WO | WO-2017/083368 A1 | 5/2017 |
| WO | WO-2017/083722 A1 | 5/2017 |
| WO | WO-2017/083766 A1 | 5/2017 |
| WO | WO-2017/087395 A1 | 5/2017 |
| WO | WO-2017/090724 A1 | 6/2017 |
| WO | WO-2017/091510 A1 | 6/2017 |
| WO | WO-2017/091630 A1 | 6/2017 |
| WO | WO-2017/092201 A1 | 6/2017 |
| WO | WO-2017/093370 A1 | 6/2017 |
| WO | WO 2017/093969 A1 | 6/2017 |
| WO | WO-2017/095111 A1 | 6/2017 |
| WO | WO-2017/096041 A1 | 6/2017 |
| WO | WO-2017/096237 A1 | 6/2017 |
| WO | WO-2017/100158 A1 | 6/2017 |
| WO | WO-2017/100431 A2 | 6/2017 |
| WO | WO-2017/104404 A1 | 6/2017 |
| WO | WO-2017/105251 A1 | 6/2017 |
| WO | WO-2017/105350 A1 | 6/2017 |
| WO | WO-2017/105991 A1 | 6/2017 |
| WO | WO-2017/106414 A1 | 6/2017 |
| WO | WO-2017/106528 A2 | 6/2017 |
| WO | WO-2017/106537 A2 | 6/2017 |
| WO | WO-2017/106569 A1 | 6/2017 |
| WO | WO-2017/106616 A1 | 6/2017 |
| WO | WO-2017/106657 A1 | 6/2017 |
| WO | WO-2017/106767 A1 | 6/2017 |
| WO | WO-2017/109134 A1 | 6/2017 |
| WO | WO 2017/109757 A1 | 6/2017 |
| WO | WO-2017/112620 A1 | 6/2017 |
| WO | WO-2017/115268 A1 | 7/2017 |
| WO | WO-2017/117395 A1 | 7/2017 |
| WO | WO 2017/118598 A1 | 7/2017 |
| WO | WO-2017/118720 A1 | 7/2017 |
| WO | WO-2017/123609 A1 | 7/2017 |
| WO | WO-2017/123910 A1 | 7/2017 |
| WO | WO-2017/124086 A1 | 7/2017 |
| WO | WO-2017/124100 A1 | 7/2017 |
| WO | WO-2017/124652 A1 | 7/2017 |
| WO | WO-2017/126987 A1 | 7/2017 |
| WO | WO-2017/127807 A1 | 7/2017 |
| WO | WO-2017/131237 A1 | 8/2017 |
| WO | WO-2017/132112 A1 | 8/2017 |
| WO | WO 2017/132580 A2 | 8/2017 |
| WO | WO-2017/136520 A1 | 8/2017 |
| WO | WO-2017/136629 A1 | 8/2017 |
| WO | WO-2017/136794 A1 | 8/2017 |
| WO | WO-2017/139264 A1 | 8/2017 |
| WO | WO-2017/139505 A2 | 8/2017 |
| WO | WO-2017/141173 A2 | 8/2017 |
| WO | WO-2017/142835 A1 | 8/2017 |
| WO | WO-2017/142999 A2 | 8/2017 |
| WO | WO-2017/143042 A2 | 8/2017 |
| WO | WO 2017/147056 A1 | 8/2017 |
| WO | WO-2017/147278 A1 | 8/2017 |
| WO | WO-2017/147432 A1 | 8/2017 |
| WO | WO-2017/147446 A1 | 8/2017 |
| WO | WO-2017/147555 A1 | 8/2017 |
| WO | WO-2017/151444 A1 | 9/2017 |
| WO | WO 2017/151719 A1 | 9/2017 |
| WO | WO-2017/152015 A1 | 9/2017 |
| WO | WO 2017/155717 A1 | 9/2017 |
| WO | WO-2017/157422 A1 | 9/2017 |
| WO | WO-2017/158153 A1 | 9/2017 |
| WO | WO-2017/160689 A1 | 9/2017 |
| WO | WO-2017/160752 A1 | 9/2017 |
| WO | WO-2017/160890 A1 | 9/2017 |
| WO | WO-2017/161068 A1 | 9/2017 |
| WO | WO-2017/165826 A1 | 9/2017 |
| WO | WO-2017/165862 A1 | 9/2017 |
| WO | WO-2017/172644 A2 | 10/2017 |
| WO | WO-2017/172645 A2 | 10/2017 |
| WO | WO-2017/172860 A1 | 10/2017 |
| WO | WO-2017/173004 A1 | 10/2017 |
| WO | WO-2017/173054 A1 | 10/2017 |
| WO | WO-2017/173092 A1 | 10/2017 |
| WO | WO-2017/174329 A1 | 10/2017 |
| WO | WO-2017/176529 A1 | 10/2017 |
| WO | WO 2017/176806 A1 | 10/2017 |
| WO | WO-2017/178590 A1 | 10/2017 |
| WO | WO-2017/180694 A1 | 10/2017 |
| WO | WO-2017/180711 A1 | 10/2017 |
| WO | WO-2017/180915 A2 | 10/2017 |
| WO | WO-2017/180926 A1 | 10/2017 |
| WO | WO-2017/181107 A2 | 10/2017 |
| WO | WO-2017/181735 A2 | 10/2017 |
| WO | WO-2017/182468 A1 | 10/2017 |
| WO | WO-2017/184334 A1 | 10/2017 |
| WO | WO-2017/184768 A1 | 10/2017 |
| WO | WO-2017/184786 A1 | 10/2017 |
| WO | WO-2017/186550 A1 | 11/2017 |
| WO | WO-2017/189308 A1 | 11/2017 |
| WO | WO-2017/189336 A1 | 11/2017 |
| WO | WO 2017/190041 A1 | 11/2017 |
| WO | WO-2017/190257 A1 | 11/2017 |
| WO | WO-2017/190664 A1 | 11/2017 |
| WO | WO-2017/191210 A1 | 11/2017 |
| WO | WO 2017/191274 A2 | 11/2017 |
| WO | WO-2017/192172 A1 | 11/2017 |
| WO | WO-2017/192512 A2 | 11/2017 |
| WO | WO-2017/192544 A1 | 11/2017 |
| WO | WO-2017/192573 A1 | 11/2017 |
| WO | WO-2017/193029 A2 | 11/2017 |
| WO | WO-2017/193053 A1 | 11/2017 |
| WO | WO-2017/196768 A1 | 11/2017 |
| WO | WO-2017/197038 A1 | 11/2017 |
| WO | WO-2017/197238 A1 | 11/2017 |
| WO | WO-2017/197301 A1 | 11/2017 |
| WO | WO 2017/201476 A1 | 11/2017 |
| WO | WO-2017/205290 A1 | 11/2017 |
| WO | WO-2017/205423 A1 | 11/2017 |
| WO | WO-2017/207589 A1 | 12/2017 |
| WO | WO-2017/208247 A1 | 12/2017 |
| WO | WO-2017/209809 A1 | 12/2017 |
| WO | WO-2017/213896 A1 | 12/2017 |
| WO | WO-2017/213898 A2 | 12/2017 |
| WO | WO-2017/214460 A1 | 12/2017 |
| WO | WO-2017/216392 A1 | 12/2017 |
| WO | WO-2017/216771 A2 | 12/2017 |
| WO | WO 2017/218185 A1 | 12/2017 |
| WO | WO-2017/219027 A1 | 12/2017 |
| WO | WO-2017/219033 A1 | 12/2017 |
| WO | WO-2017/220751 A1 | 12/2017 |
| WO | WO-2017/222370 A1 | 12/2017 |
| WO | WO-2017/222773 A1 | 12/2017 |
| WO | WO-2017/222834 A1 | 12/2017 |
| WO | WO-2017/223107 A1 | 12/2017 |
| WO | WO-2017/223330 A1 | 12/2017 |
| WO | WO-2018/000657 A1 | 1/2018 |
| WO | WO-2018/002719 A1 | 1/2018 |
| WO | WO-2018/005117 A1 | 1/2018 |
| WO | WO-2018/005289 A2 | 1/2018 |
| WO | WO-2018/005691 A1 | 1/2018 |

(56) References Cited

FOREIGN PATENT DOCUMENTS

| | | |
|---|---|---|
| WO | WO-2018/005782 A1 | 1/2018 |
| WO | WO-2018/005873 A1 | 1/2018 |
| WO | WO 2018/06693 A1 | 1/2018 |
| WO | WO-2018/009520 A1 | 1/2018 |
| WO | WO-2018/009562 A1 | 1/2018 |
| WO | WO-2018/009822 A1 | 1/2018 |
| WO | WO-2018/013821 A1 | 1/2018 |
| WO | WO 2018/013932 A1 | 1/2018 |
| WO | WO-2018/013990 A1 | 1/2018 |
| WO | WO-2018/014384 A1 | 1/2018 |
| WO | WO-2018/015444 A1 | 1/2018 |
| WO | WO-2018/015936 A2 | 1/2018 |
| WO | WO-2018/017754 A1 | 1/2018 |
| WO | WO-2018/018979 A1 | 2/2018 |
| WO | WO-2018/020248 A1 | 2/2018 |
| WO | WO 2018/021878 A1 | 2/2018 |
| WO | WO-2018/022480 A1 | 2/2018 |
| WO | WO-2018/022634 A1 | 2/2018 |
| WO | WO-2018/025206 A1 | 2/2018 |
| WO | WO-2018/026723 A1 | 2/2018 |
| WO | WO-2018/026976 A1 | 2/2018 |
| WO | WO-2018/027078 A1 | 2/2018 |
| WO | WO 2018/030608 A1 | 2/2018 |
| WO | WO-2018/031683 A1 | 2/2018 |
| WO | WO-2018/035250 A1 | 2/2018 |
| WO | WO-2018/035300 A1 | 2/2018 |
| WO | WO-2018/035423 A1 | 2/2018 |
| WO | WO-2018/035503 A1 | 2/2018 |
| WO | WO-2018027078 A1 * | 2/2018 ............... C12N 9/78 |
| WO | WO-2018/039145 A1 | 3/2018 |
| WO | WO-2018/039438 A1 | 3/2018 |
| WO | WO-2018/039440 A1 | 3/2018 |
| WO | WO-2018/039448 A1 | 3/2018 |
| WO | WO-2018/045630 A1 | 3/2018 |
| WO | WO-2018/048827 A1 | 3/2018 |
| WO | WO 2018/049073 A1 | 3/2018 |
| WO | WO-2018/049168 A1 | 3/2018 |
| WO | WO-2018/051347 A1 | 3/2018 |
| WO | WO-2018/058064 A1 | 3/2018 |
| WO | WO-2018/062866 A2 | 4/2018 |
| WO | WO-2018/064352 A1 | 4/2018 |
| WO | WO-2018/064371 A1 | 4/2018 |
| WO | WO-2018/064516 A1 | 4/2018 |
| WO | WO-2018/067546 A1 | 4/2018 |
| WO | WO-2018/067846 A1 | 4/2018 |
| WO | WO-2018/068053 A2 | 4/2018 |
| WO | WO-2018/069474 A1 | 4/2018 |
| WO | WO-2018/071623 A2 | 4/2018 |
| WO | WO-2018/071663 A1 | 4/2018 |
| WO | WO-2018/071868 A1 | 4/2018 |
| WO | WO-2018/071892 A1 | 4/2018 |
| WO | WO-2018/074979 | 4/2018 |
| WO | WO-2018/079134 A1 | 5/2018 |
| WO | WO-2018/080573 A1 | 5/2018 |
| WO | WO-2018/081504 A1 | 5/2018 |
| WO | WO-2018/081535 A2 | 5/2018 |
| WO | WO-2018/081728 A1 | 5/2018 |
| WO | WO-2018/083128 A2 | 5/2018 |
| WO | WO 2018/083606 A1 | 5/2018 |
| WO | WO-2018/085288 A1 | 5/2018 |
| WO | WO 2018/085414 A1 | 5/2018 |
| WO | WO-2018/086623 A1 | 5/2018 |
| WO | WO 2018/089664 A1 | 5/2018 |
| WO | WO-2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A1 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A1 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A1 | 8/2018 |
| WO | WO 2018/156372 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/051097 A1 | 3/2019 |
| WO | WO 2019/079347 | 4/2019 |
| WO | WO 2019/084062 A1 | 5/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/226953 A1 | 11/2019 |
| WO | WO 2019/236566 A1 | 12/2019 |
| WO | WO 2020/014261 A1 | 1/2020 |
| WO | WO 2020/028555 A2 | 2/2020 |
| WO | WO 2020/041751 A1 | 2/2020 |

(56) References Cited

FOREIGN PATENT DOCUMENTS

| WO | WO 2020/047124 A1 | 3/2020 |
|---|---|---|
| WO | WO 2020/051360 A1 | 3/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/154500 A1 | 7/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A1 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/210751 A1 | 10/2020 |
| WO | WO 2020/214842 A1 | 10/2020 |

OTHER PUBLICATIONS

[No Author Listed], Thermo Fisher Scientific—How Cationic Lipid Mediated Transfection Works, retrieved from the internet Aug. 27, 2015. 2 pages.
Abudayyeh et al., C2c2 is a single-component programmable RNA-guided RNA-targeting CRISPR effector. Science Aug. 2016;353(6299):aaf5573. DOI: 10.1126/science.aaf5573.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Alexandrov et al., Signatures of mutational processes in human cancer. Nature. Aug. 22, 2013;500(7463):415-21.doi: 10.1038/nature12477. Epub Aug. 14, 2013.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Arnold et al., Mutants of Tn3 resolvase which do not require accessory binding sites for recombination activity. EMBO J. Mar. 1, 1999;18(5):1407-14.
Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Beale et al., Comparison of the differential context-dependence of DNA deamination by APOBEC enzymes: correlation with mutation spectra in vivo. J Mol Biol. Mar. 26, 2004;337(3):585-96.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Beumer et al., Efficient gene targeting in Drosophila with zinc-finger nucleases. Genetics. Apr. 2006;172(4):2391-403. Epub Feb. 1, 2006.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9 16.
Bitinaite et al., FokI dimerization is required for DNA cleavage. Proc Natl Acad Sci U S A. Sep. 1, 1998;95(18):10570-5.
Boch, Tales of genome targeting. Nat Biotechnol. Feb. 2011;29(2):135-6. Doi: 10.1038/nbt.1767.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Bolotin et al., Clustered regularly interspaced short palindrome repeats (CRISPRs) have spacers of extrachromosomal origin. Microbiology. Aug. 2005;151(Pt 8):2551-61.
Borman, Improved route to single-base genome editing. Chemical & Engineering News, Apr. 25, 2016;94(17)p5. http://cen.acs.org/articles/94/i17/Improved-route-single-base-genome.html.
Branden and Tooze, Introduction to Protein Structure. 1999; 2nd edition. Garland Science Publisher: 3-12.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., Serine recombinases as tools for genome engineering. Methods. Apr. 2011;53(4):372-9. doi: 10.1016/j.ymeth.2010.12.031. Epub Dec. 30, 2010.
Brusse et al., Spinocerebellar ataxia associated with a mutation in the fibroblast growth factor 14 gene (SCA27): A new phenotype. Mov Disord. Mar. 2006;21(3):396-401.
Buchholz et al., Alteration of Cre recombinase site specificity by substrate-linked protein evolution. Nat Biotechnol. Nov. 2001;19(11):1047-52.
Buchwald et al., Long-term, continuous intravenous heparin administration by an implantable infusion pump in ambulatory patients with recurrent venous thrombosis. Surgery. Oct. 1980;88(4):507-16.
Bulow et al., Multienzyme systems obtained by gene fusion. Trends Biotechnol. Jul. 1991;9(7):226-31.
Burstein et al., New CRISPR-Cas systems from uncultivated microbes. Nature Feb. 2017;542(7640):237-240.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Caldecott et al., Single-strand break repair and genetic disease. Nat Rev Genet. Aug. 2008;9(8):619-31. doi: 10.1038/nrg2380.
Cameron, Recent advances in transgenic technology. Mol Biotechnol. Jun. 1997;7(3):253-65.
Cargill et al.,Characterization of single-nucleotide polymorphisms in coding regions of human genes. Nat Genet. Jul. 1999;22(3):231-8.
Caron et al., Intracellular delivery of a Tat-eGFP fusion protein into muscle cells. Mol Ther. Mar. 2001;3(3):310-8.
Carroll et al., Gene targeting in Drosophila and Caenorhabditis elegans with zinc-finger nucleases. Methods Mol Biol. 2008;435:63-77. doi: 10.1007/978-1-59745-232-8 5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

(56) References Cited

OTHER PUBLICATIONS

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Charpentier et al., Biotechnology: Rewriting a genome. Nature. Mar. 7, 2013;495(7439):50-1. doi: 10.1038/495050a.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. Jun. 14, 2016. doi:https://doi.org/10.1101/058974. [Preprint].
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chesnoy et al., Structure and function of lipid-DNA complexes for gene delivery. Annu Rev Biophys Biomol Struct. 2000;29:27-47.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chichili et al., Linkers in the structural biology of protein-protein interactions. Protein Science. 2013;22:153-67.
Chipev et al., A leucine—proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Chu et al., Increasing the efficiency of homology-directed repair for CRISPR-Cas9-induced precise gene editing in mammalian cells. Nat Biotech. Feb. 13, 2015;33:543-8.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cole-Strauss et al., Correction of the mutation responsible for sickle cell anemia by an RNA-DNA oligonucleotide. Science. Sep. 6, 1996;273(5280):1386-9.
Cong et al., Multiplex genome engineering using CRISPR/Cas systems. Science. Feb. 15, 2013;339(6121):819-23. doi: 10.1126/science.1231143. Epub Jan. 3, 2013.
Conticello, The AID/APOBEC family of nucleic acid mutators. Genome Biol. 2008;9(6):229. doi: 10.1186/GB-2008-9-6-229. Epub Jun. 17, 2008.
Covino et al., The CCL2/CCR2 Axis in the Pathogenesis of HIV-1 Infection: A New Cellular Target for Therapy? Current Drug Targets Dec. 2016;17(1):76-110. DOI : 10.2174/1389450117015121710917.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Therapeutic genome editing: prospects and challenges. Nat Med. Feb. 2015;21(2):121-31. doi: 10.1038/nm.3793.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011; 12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Souza, Primer: genome editing with engineered nucleases. Nat Methods. Jan. 2012;9(1):27.
Deltcheva et al., CRISPR RNA maturation by trans-encoded small RNA and host factor RNase III. Nature. Mar. 31, 2011;471(7340):602-7. doi: 10.1038/nature09886.
Dicarlo et al., Genome engineering in *Saccharomyces cerevisiae* using CRISPR-Cas systems. Nucleic Acids Research Apr. 2013;41(7):4336-43.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Extended European Search Report for EP 15830407.1, dated Mar. 2, 2018.
Ferretti et al., Complete genome sequence of an M1 strain of *Streptococcus pyogenes*. Proc Natl Acad Sci U S A. Apr. 10, 2001;98(8):4658-63.

(56) References Cited

OTHER PUBLICATIONS

Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gardlik et al., Vectors and delivery systems in gene therapy. Med Sci Monit. Apr. 2005;11(4):RA110-21. Epub Mar. 24, 2005.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
GENBANK Submission; NIH/NCBI, Accession No. J04623. Kita et al., Apr. 26, 1993. 2 pages.
GENBANK Submission; NIH/NCBI, Accession No. NC_002737.1. Ferretti et al., Jun. 27, 2013. 1 page.
GENBANK Submission; NIH/NCBI, Accession No. NC_015683.1. Trost et al., Jul. 6, 2013. 1 page.
GENBANK Submission; NIH/NCBI, Accession No. NC_016782.1. Trost et al., Jun. 11, 2013. 1 page.
GENBANK Submission; NIH/NCBI, Accession No. NC_016786.1. Trost et al., Aug. 28, 2013. 1 page.
GENBANK Submission; NIH/NCBI, Accession No. NC_017053.1. Fittipaldi et al., Jul. 6, 2013. 1 page.
GENBANK Submission; NIH/NCBI, Accession No. NC_017317.1. Trost et al., Jun. 11, 2013. 1 page.
GENBANK Submission; NIH/NCBI, Accession No. NC_017861.1. Heidelberg et al., Jun. 11, 2013. 1 page.
GENBANK Submission; NIH/NCBI, Accession No. NC_018010.1. Lucas et al., Jun. 11, 2013. 2 pages.
GENBANK Submission; NIH/NCBI, Accession No. NC_018721.1. Feng et al., Jun. 11, 2013. 1 pages.
GENBANK Submission; NIH/NCBI, Accession No. NC_021284.1. Ku et al., Jul. 12, 2013. 1 page.
GENBANK Submission; NIH/NCBI, Accession No. NC_021314.1. Zhang et al., Jul. 15, 2013. 1 page.
GENBANK Submission; NIH/NCBI, Accession No. NC_021846.1. Lo et al., Jul. 22, 2013. 1 page.
GENBANK Submission; NIH/NCBI, Accession No. NP_472073.1. Glaser et al., Jun. 27, 2013. 2 pages.
GENBANK Submission; NIH/NCBI, Accession No. P42212. Prasher et al., Mar. 19, 2014. 7 pages.
GENBANK Submission; NIH/NCBI, Accession No. YP_002342100.1. Bernardini et al., Jun. 10, 2013. 2 pages.
GENBANK Submission; NIH/NCBI, Accession No. YP_002344900.1. Gundogdu et al., Mar. 19, 2014. 2 pages.
GENBANK Submission; NIH/NCBI, Accession No. YP_820832.1. Makarova et al., Aug. 27, 2013. 2 pages.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.
Hale et al., RNA-guided RNA cleavage by a CRISPR RNA-Cas protein complex. Cell. Nov. 25, 2009;139(5):945-56. doi: 10.1016/j.cell.2009.07.040.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.

(56) References Cited

OTHER PUBLICATIONS

Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Heller et al., Replisome assembly and the direct restart of stalled replication forks. Nat Rev Mol Cell Biol. Dec. 2006;7(12):932-43. Epub Nov. 8, 2006.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hill et al., Functional analysis of conserved histidines in ADP-glucose pyrophosphorylase from *Escherichia coli*.Biochem Biophys Res Commun. Mar. 17, 1998;244(2):573-7.
Hilton et al., Enabling functional genomics with genome engineering. Genome Res. Oct. 2015;25(10):1442-55. doi: 10.1101/gr.190124.115.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.
Horvath et al., CRISPR/Cas, the immune system of bacteria and archaea. Science. Jan. 8, 2010;327(5962):167-70. doi: 10.1126/science.1179555.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Huang et al., Heritable gene targeting in zebrafish using customized TALENs. Nat Biotechnol. Aug. 5, 2011;29(8):699-700. doi: 10.1038/nbt.1939.
Humbert et al., Targeted gene therapies: tools, applications, optimization. Crit RevBiochem Mol Biol. May-Jun. 2012;47(3):264-81. doi: 10.3109/10409238.2012.658112.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Ikediobi et al., Mutation analysis of 24 known cancer genes in the NCI-60 cell line set. Mol Cancer Ther. Nov. 2006;5(11):2606-12. Epub Nov. 6, 2006.
International Preliminary Report on Patentability for PCT/US2016/058344, dated May 3, 2018.
International Preliminary Report on Patentability for PCT/US2012/047778, dated Feb. 6, 2014.
International Preliminary Report on patentability for PCT/US2014/050283, dated Feb. 18, 2016.
International Preliminary Report on Patentability for PCT/US2014/052231, dated Mar. 3, 2016.
International Preliminary Report on Patentability for PCT/US2014/054247, dated Mar. 17, 2016.
International Preliminary Report on Patentability for PCT/US2014/054291, dated Mar. 17, 2016.
International Preliminary Report on Patentability for PCT/US2014/070038, dated Jun. 23, 2016.
International Preliminary Report on Patentability for PCT/US2015/042770, dated Dec. 19, 2016.
International Preliminary Report on Patentability for PCT/US2015/058479, dated May 11, 2017.
International Preliminary Report on Patentability or PCT/US2014/054252, dated Mar. 17, 2016.
International Search Report and Written Opinion for PCT/US2012/047778, dated May 30, 2013.
International Search Report and Written Opinion for PCT/US2014/050283, dated Nov. 6, 2014.
International Search Report and Written Opinion for PCT/US2014/052231, dated Dec. 4, 2014.
International Search Report and Written Opinion for PCT/US2014/052231, dated Jan. 30, 2015. (Corrected Version).
International Search Report and Written Opinion for PCT/US2014/054247, dated Mar. 27, 2015.
International Search Report and Written Opinion for PCT/US2014/054252, dated Mar. 5, 2015.
International Search Report and Written Opinion for PCT/US2014/054291, dated Mar. 27, 2015.
International Search Report and Written Opinion for PCT/US2014/070038, dated Apr. 14, 2015.
International Search Report and Written Opinion for PCT/US2015/042770, dated Feb. 23, 2016.
International Search Report and Written Opinion for PCT/US2015/058479, dated Feb. 11, 2016.
International Search Report and Written Opinion for PCT/US2016/044546, dated Dec. 28, 2016.
International Search Report and Written Opinion for PCT/US2016/058344, dated Apr. 20, 2017.
International Search Report and Written Opinion for PCT/US2017/045381, dated Oct. 26, 2017.
International Search Report and Written Opinion for PCT/US2017/046144, dated Oct. 10, 2017.
International Search Report and Written Opinion for PCT/US2017/056671, dated Feb. 20, 2018.
International Search Report and Written Opinion for PCT/US2017/068105, dated Apr. 4, 2018.
International Search Report and Written Opinion for PCT/US2017/068114, dated Mar. 20, 2018.
International Search Report and Written Opinion for PCT/US2017/48390, dated Jan. 9, 2018.
International Search Report for PCT/US2013/032589, dated Jul. 26, 2013.
Invitation to Pay Additional Fees for PCT/US2014/054291, dated Dec. 18, 2014.
Invitation to Pay Additional Fees for PCT/US2016/058344, dated Mar. 1, 2017.
Invitation to Pay Additional Fees for PCT/US2017/056671, dated Dec. 21, 2017.
Invitation to Pay Additional Fees for PCT/US2017/48390, dated Nov. 7, 2017.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.

(56) References Cited

OTHER PUBLICATIONS

Jansen et al., Identification of genes that are associated with DNA repeats in prokaryotes. Mol Microbiol. Mar. 2002;43(6):1565-75.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al., TALENs: a widely applicable technology for targeted genome editing. Nat Rev Mol Cell Biol. Jan. 2013;14(1):49-55. doi: 10.1038/nrm3486. Epub Nov. 21, 2012.
Kaiser et al., Gene therapy. Putting the fingers on gene repair. Science. Dec. 23, 2005;310(5756):1894-6.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kappel et al., Regulating gene expression in transgenic animals. Curr Opin Biotechnol. Oct. 1992;3(5):548-53.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Kaya et al., A bacterial Argonaute with noncanonical guide RNA specificity. Proc. Natl. Acad. Sci. USA Apr. 2016;113(15):4057-62.
Kellendonk et al., Regulation of Cre recombinase activity by the synthetic steroid RU 486. Nucleic Acids Res. Apr. 15, 1996;24(8):1404-11.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunz et al., DNA Repair in mammalian cells: Mismatched repair: variations on a theme. Cell Mol Life Sci. Mar. 2009;66(6):1021-38. doi: 10.1007/S00018-009-8739-9.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

(56) References Cited

OTHER PUBLICATIONS

Lau et al., Molecular basis for discriminating between normal and damaged bases by the human alkyladenine glycosylase, AAG. Proc Natl Acad Sci U S A. Dec. 5, 2000;97(25):13573-8.

Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lazar et al., Transforming growth factor alpha: mutation of aspartic acid 47 and leucine 48 results in different biological activities. Mol Cell Biol. Mar. 1988;8(3):1247-52.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.

Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

Levy et al., Inhibition of calcification of bioprosthetic heart valves by local controlled-release diphosphonate. Science. Apr. 12, 1985;228(4696):190-2.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Codon 129 polymorphism of the human prion protein influences the kinetics of amyloid formation. J Gen Virol. Aug. 2006;87(Pt 8):2443-9.

Li et al., Current approaches for engineering proteins with diverse biological properties. Adv Exp Med Biol. 2007;620:18-33.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

Lieber et al., Mechanism and regulation of human non-homologous DNA end-joining. Nat Rev Mol Cell Biol. Sep. 2003;4(9):712-20.

Lin et al., Enhanced homology-directed human genome engineering by controlled timing of CRISPR/Cas9 delivery. Elife. Dec. 15, 2014;3:e04766. doi: 10.7554/eLife.04766.

Liu et al., C2c1-sgRNA Complex Structure Reveals RNA-Guided DNA Cleavage Mechanism. Molecular Cell Jan. 2017;65(2):310-22.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.

Liu et al., Design of polydactyl zinc-finger proteins for unique addressing within complex genomes. Proc Natl Acad Sci U S A. May 27, 1997;94(11):5525-30.

Liu et al., Distance determination by GIY-YIG intron endonucleases: discrimination between repression and cleavage functions. Nucleic Acids Res. Mar. 31, 2006;34(6):1755-64. Print 2006.

Liu et al., Fast Colorimetric Sensing of Adenosine and Cocaine Based on a General Sensor Design Involving Aptamers and Nanoparticles. Angew Chem. 2006;118(1):96-100.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Losey et al., Crystal structure of *Staphylococcus sureus* tRNA adenosine deaminase tadA in complex with RNA. Nature Struct. Mol. Biol. Feb. 2006;13(2):153-9.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Lyons et al., Efficient Recognition of an Unpaired Lesion by a DNA Repair Glycosylase. J. Am. Chem. Soc., 2009;131(49):17742-3. DOI: 10.1021/ja908378y.

Ma et al., Targeted AID-mediated mutagenesis (TAM) enables efficient genomic diversification in mammalian cells. Nature Methods. Oct. 2016;13:1029-35. doi:10.1038/nmeth.4027.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Makarova et al., Prokaryotic homologs of Argonaute proteins are predicted to function as key components of a novel system of defense against mobile genetic elements. Biology Direct 2009;4:29.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Evolution and classification of the CRISPR-Cas systems. Nat Rev Microbiol. Jun. 2011;9(6):467-77. doi: 10.1038/nrmicro2577. Epub May 9, 2011.

Mali et al., Cas9 as a versatile tool for engineering biology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

(56) References Cited

OTHER PUBLICATIONS

Mali et al., RNA-guided human genome engineering via Cas9. Science. Feb. 15, 2013;339(6121):823-6. doi: 10.1126/science.1232033. Epub Jan. 3, 2013.

Mani et al., Design, engineering, and characterization of zinc finger nucleases. Biochem Biophys Res Commun. Sep. 23, 2005;335(2):447-57.

Marioni et al., DNA methylation age of blood predicts all-cause mortality in later life. Genome Biol. Jan. 30, 2015;16:25. doi: 10.1186/s13059-015-0584-6.

Marraffini et al., CRISPR interference limits horizontal gene transfer in staphylococci by targeting DNA. Science. Dec. 19, 2008;322(5909):1843-5. doi: 10.1126/science.1165771.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Miller et al., A TALE nuclease architecture for efficient genome editing. Nat Biotechnol. Feb. 2011;29(2):143-8. doi: 10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mojica et al., Intervening sequences of regularly spaced prokaryotic repeats derive from foreign genetic elements. J Mol Evol. Feb. 2005;60(2):174-82.

Mol et al., Crystal structure of human uracil-DNA glycosylase in complex with a protein inhibitor: protein mimicry of DNA. Cell. Sep. 8, 1995;82(5):701-8.

Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mullins et al., Transgenesis in nonmurine species. Hypertension. Oct. 1993;22(4):630-3.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Nahvi et al., Coenzyme B12 riboswitches are widespread genetic control elements in prokaryotes. Nucleic Acids Res. Jan. 2, 2004;32(1):143-50.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

Noris et al., A phenylalanine-55 to serine amino-acid substitution in the human glycoprotein IX leucine-rich repeat is associated with Bernard-Soulier syndrome. Br J Haematol. May 1997;97(2):312-20.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

Offord, Advances in Genome Editing. The Scientist, Apr. 20, 2016. http://www.the-scientist.com/?articles.view/articleNo/45903/title/Advances-in-Genome-Editing/.

Osborn et al., TALEN-based gene correction for epidermolysis bullosa. Mol Ther. Jun. 2013;21(6):1151-9. doi: 10.1038/mt.2013.56. Epub Apr. 2, 2013.

Pan et al., Biological and biomedical applications of engineered nucleases. Mol Biotechnol. Sep. 2013;55(1):54-62. doi: 10.1007/s12033-012-9613-9.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Partial Supplementary European Search Report for Application No. EP 12845790.0, dated Mar. 18, 2015.

Pattanayak et al., Determining the specificities of TALENs, Cas9, and other genome-editing enzymes. Methods Enzymol. 2014;546:47-78. doi: 10.1016/B978-0-12-801185-0.00003-9.

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-DNA recognition: crystal structure of a Zif268-DNA complex at 2.1 A. Science. May 10, 1991;252(5007):809-17.

Pennisi et al., The CRISPR craze. Science. Aug. 23, 2013;341(6148):833-6. doi: 10.1126/science.341.6148.833.

Pennisi et al., The tale of the TALES. Science. Dec. 14, 2012;338(6113):1408-11. doi: 10.1126/science.338.6113.1408.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

(56) References Cited

OTHER PUBLICATIONS

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Petek et al., Frequent endonuclease cleavage at off-target locations in vivo. Mol Ther. May 2010;18(5):983-6. Doi: 10.1038/mt.2010.35. Epub Mar. 9, 2010.

Petolino et al., Editing Plant Genomes: a new era of crop improvement. Plant Biotechnol J. Feb. 2016;14(2):435-6. doi: 10.1111/pbi.12542.

Phillips, The challenge of gene therapy and DNA delivery. J Pharm Pharmacol. Sep. 2001;53(9):1169-74.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.

Poller et al., A leucine-to-proline substitution causes a defective alpha 1-antichymotrypsin allele associated with familial obstructive lung disease. Genomics. Sep. 1993;17(3):740-3.

Porteus, Design and testing of zinc finger nucleases for use in mammalian cells. Methods Mol Biol. 2008;435:47-61. doi: 10.1007/978-1-59745-232-8 4.

Pourcel et al., CRISPR elements in Yersinia pestis acquire new repeats by preferential uptake of bacteriophage DNA, and provide additional tools for evolutionary studies. Microbiology. Mar. 2005;151(Pt3):653-63.

Prashant et al., CAS9 transcriptional activators for target specificity screening and paired nickases for cooperative genome engineering. Nature Biotechnology 2013;31(9):833-8.

Prorocic et al., Zinc-finger recombinase activities in vitro. Nucleic Acids Res. Nov. 2011;39(21):9316-28. doi: 10.1093/nar/gkr652. Epub Aug. 17, 2011.

Proudfoot et al., Zinc finger recombinases with adaptable DNA sequence specificity. PLoS One. Apr. 29, 2011;6(4):e19537. doi: 10.1371/journal.pone.0019537.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.

Qi et al., Repurposing CRISPR as an RNA-guided platform for sequence-specific control of gene expression. Cell. Feb. 28, 2013;152(5):1173-83. doi: 10.1016/j.cell.2013.02.022.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Rath et al., Fidelity of end joining in mammalian episomes and the impact of Metnase on joint processing. BMC Mol Biol. Mar. 22, 2014;15:6. doi: 10.1186/1471-2199-15-6.

Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).

Ray et al., Homologous recombination: ends as the means. Trends Plant Sci. Oct. 2002;7(10):435-40.

Rebuzzini et al., New mammalian cellular systems to study mutations introduced at the break site by non-homologous end-joining. DNA Repair (Amst). May 2, 2005;4(5):546-55.

Rees et al., Improving the DNA specificity and applicability of base editing through protein engineering and protein delivery. Nat Commun. Jun. 6, 2017;8:15790. doi: 10.1038/ncomms15790.

Reyon et al., FLASH assembly of TALENs for high-throughput genome editing. Nat Biotechnol. May 2012;30(5):460-5. doi: 10.1038/nbt.2170.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Richter et al., Function and regulation of clustered regularly interspaced short palindromic repeats (CRISPR) / CRISPR associated (Cas) systems. Viruses. Oct. 19, 2012;4(10):2291-311. doi: 10.3390/V4102291.

Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

Rowland et al., Regulatory mutations in Sin recombinase support a structure-based model of the synaptosome. Mol Microbiol. Oct. 2009;74(2):282-98. doi: 10.1111/j.1365-2958.2009.06756.X. Epub Jun. 8, 2009.

Sadelain et al., Safe harbours for the integration of new DNA in the human genome. Nat Rev Cancer. Dec. 1, 2011;12(1):51-8. doi: 10.1038/nrc3179.

Sage et al., Proliferation of functional hair cells in vivo in the absence of the retinoblastoma protein. Science. Feb. 18, 2005;307(5712):1114-8. Epub Jan. 13, 2005.

Samal et al., Cationic polymers and their therapeutic potential. Chem Soc Rev. Nov. 7, 2012;41(21):7147-94. doi: 10.1039/c2cs35094g. Epub Aug. 10, 2012.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Sang, Prospects for transgenesis in the chick. Mech Dev. Sep. 2004;121(9):1179-86.

Sanjana et al., A transcription activator-like effector toolbox for genome engineering. Nat Protoc. Jan. 5, 2012;7(1):171-92. doi: 10.1038/nprot.2011.431.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.

(56) References Cited

OTHER PUBLICATIONS

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Saudek et al., A preliminary trial of the programmable implantable medication system for insulin delivery. N Engl J Med. Aug. 31, 1989;321(9):574-9.
Schriefer et al., Low pressure DNA shearing: a method for random DNA sequence analysis. Nucleic Acids Res. Dec. 25, 1990;18(24):7455-6.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Seripa et al., The missing ApoE allele. Ann Hum Genet. Jul. 2007;71(Pt 4):496-500. Epub Jan. 22, 2007.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Target-specific variants of Flp recombinase mediate genome engineering reactions in mammalian cells. FEBS J. Sep. 2015;282(17):3323-33. doi: 10.1111 /febs.13345. Epub Jul. 1, 2015.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shmakov et al., Discovery and Functional Characterization of Diverse Class 2 CRISPR Cas Systems. Molecular Cell Nov. 2015;60(3):385-97.
Siebert et al., An improved PCR method for walking in uncloned genomic DNA. Nucleic Acids Res. Mar. 25, 1995;23(6):1087-8.
Simonelli et al., Base excision repair intermediates are mutagenic in mammalian cells. Nucleic Acids Res. Aug. 2, 2005;33(14):4404-11. Print 2005.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Sjoblom et al., The consensus coding sequences of human breast and colorectal cancers. Science. Oct. 13, 2006;314(5797):268-74. Epub Sep. 7, 2006.
Slaymaker et al., Rationally engineered Cas9 nucleases with improved specificity. Science. Jan. 1, 2016;351(6268):84-8. doi: 10.1126/science.aad5227. Epub Dec. 1, 2015.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stephens et al., The landscape of cancer genes and mutational processes in breast cancer. Nature Jun. 2012;486:400-404. doi: 10.1038/nature11017.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Supplementary European Search Report for Application No. EP 12845790.0, dated Oct. 12, 2015.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tagalakis et al., Lack of RNA-DNA oligonucleotide (chimeraplast) mutagenic activity in mouse embryos. Mol Reprod Dev. Jun. 2005;71(2):140-4.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12-396962-0.00012-4.
Thorpe et al., Functional correction of episomal mutations with short DNA fragments and RNA-DNA oligonucleotides. J Gene Med. Mar.-Apr. 2002;4(2):195-204.

(56) References Cited

OTHER PUBLICATIONS

Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Vitreschak et al., Regulation of the vitamin B12 metabolism and transport in bacteria by a conserved RNA structural element. RNA. Sep. 2003;9(9):1084-97.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Genetic screens in human cells using the CRISPR-Cas9 system. Science. Jan. 3, 2014;343(6166):80-4. doi: 10.1126/science. 1246981. Epub Dec. 12, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Recombinase technology: applications and possibilities. Plant Cell Rep. Mar. 2011;30(3):267-85. doi: 10.1007/S00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Weber et al., Assembly of designer TAL effectors by Golden Gate cloning. PLoS One. 2011;6(5):e19722. doi:10.1371/journal.pone. 0019722. Epub May 19, 2011.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants. 2008.09.004. Epub Oct. 22, 2008.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science. 1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr. 191452.115. Epub Jun. 10, 2015.
Yamano et al., Crystal Structure of Cpf1 in Complex with Guide RNA and Target DNA. Cell May 2016;165(4)949-62.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.

(56) References Cited

OTHER PUBLICATIONS

Yang et al., PAM-dependent Target DNA Recognition and Cleavage by C2C1 CRISPR-Cas endonuclease. Cell Dec. 2016;167(7):1814-28.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang UnivSci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Stabilized plasmid-lipid particles for regional gene therapy: formulation and transfection properties. Gene Ther. Aug. 1999;6(8):1438-47.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zuris et al., Cationic lipid-mediated delivery of proteins enables efficient protein-based genome editing in vitro and in vivo. Nat Biotechnol. 2015;33:73-80.
U.S. Appl. No. 61/874,746, filed Sep. 6, 2013, Liu et al.
U.S. Appl. No. 61/874,682, filed Sep. 6, 2013, Liu et al.
U.S. Appl. No. 61/838,178, filed Jun. 21, 2013, Joung et al.
U.S. Appl. No. 61/837,481, filed Jun. 20, 2013, Cho et al.
U.S. Appl. No. 61/803,599, filed Mar. 20, 2013, Kim et al.
U.S. Appl. No. 61/794,422, filed Mar. 15, 2013, Knight et al.
U.S. Appl. No. 61/761,046, filed Feb. 5, 2013, Knight et al.
U.S. Appl. No. 61/758,624, filed Jan. 30, 2013, Chen et al.
U.S. Appl. No. 61/734,256, filed Dec. 6, 2012, Chen et al.
U.S. Appl. No. 61/717,324, filed Oct. 23, 2012, Cho et al.
U.S. Appl. No. 61/716,256, filed Oct. 19, 2012, Jinek et al.
U.S. Appl. No. 62/357,332, filed Jun. 30, 2016, Liu et al.
U.S. Appl. No. 62/288,661, filed Jan. 29, 2016, Muir et al.
[No Author Listed] Score result for SEQ 355 to WO2017032580. Muir et al. 2016.
Aihara et al., A conformational switch controls the DNA cleavage activity of lambda integrase. Mol Cell. Jul. 2003;12(1):187-98.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Batey et al., Structure of a natural guanine-responsive riboswitch complexed with the metabolite hypoxanthine. Nature. Nov. 18, 2004;432(7015):411-5.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Böck et al., Selenocysteine: the 21st amino acid. Mol Microbiol. Mar. 1991;5(3):515-20.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Briner et al., Guide RNA functional modules direct Cas9 activity and orthogonality. Mol Cell. Oct. 23, 2014;56(2):333-339. doi: 10.1016/j.molcel.2014.09.019.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Burke et al., RNA Aptamers to the Adenosine Moiety of S-adenosyl Methionine: Structural Inferences From Variations on a Theme and the Reproducibility of SELEX.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Carroll, Genome engineering with zinc-finger nucleases. Genetics. Aug. 2011;188(4):773-82. doi: 10.1534/genetics.111.131433. Review.
Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018. bioRxiv preprint first posted online Jun. 14, 2016.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., Fusion protein linkers: property, design and functionality. Adv Drug Deliv Rev. Oct. 2013;65(10):1357-69. doi:10.1016/j.addr.2012.09.039. Epub Sep. 29, 2012.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
D'Adda di Fagagna et al., The Gam protein of bacteriophage Mu is an orthologue of eukaryotic Ku. EMBO Rep. Jan. 2003;4(1):47-52.
Davis et al., DNA double strand break repair via non-homologous end-joining. Transl Cancer Res. Jun. 2013;2(3):130-143.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Edwards et al., An *Escherichia coli* tyrosine transfer RNA is a leucine-specific transfer RNA in the yeast *Saccharomyces cerevisiae*. Proc Nad Acad Sci U S A. Feb. 15, 1991;88(4):1153-6.

(56) References Cited

OTHER PUBLICATIONS

Edwards et al., Crystal structures of the thi-box riboswitch bound to thiamine pyrophosphate analogs reveal adaptive RNA-small molecule recognition. Structure. Sep. 2006;14(9):1459-68.
Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Endo et al., Toward establishing an efficient and versatile gene targeting system in higher plants. Biocatalysis and Agricultural Biotechnology 2014;3,(1):2-6.
Esvelt et al., A system for the continuous directed evolution of biomolecules. Nature. Apr. 28, 2011;472(7344):499-503. doi: 10.1038/nature09929. Epub Apr. 10, 2011.
Fagerlund et al., The Cpf1 CRISPR-Cas protein expands genome-editing tools. Genome Biology Nov. 17, 2015;16:251. https://doi.org/10.1186/s13059-015-0824-9.
Fang et al., Synthetic Studies Towards Halichondrins: Synthesis of the Left Halves of Norhalichondrins and Homohalichondrins. Tetrahedron Letters 1992;33(12):1557-1560.
Farhood et al., Codelivery to mammalian cells of a transcriptional factor with cis-acting element using cationic liposomes. Anal Biochem. Feb. 10, 1995;225(1):89-93.
Felletti et al., Twister Ribozymes as Highly Versatile Expression Platforms for Artificial Riboswitches. Nat Commun. Sep. 27, 2016;7:12834. doi: 10.1038/ncomms12834.
Ferry et al., Rational design of inducible CRISPR guide RNAs for de novo assembly of transcriptional programs. Nat Commun. Mar. 3, 2017;8:14633. doi: 10.1038/ncomms14633.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
GENBANK Submission; NIH/NCBI, Accession No. NM_174936. Guo et al., Oct. 28, 2015. 6 pages.
Haeussler et al., Evaluation of off-target and on-target scoring algorithms and integration into the guide RNA selection tool CRISPOR. Genome Biol. Jul. 5, 2016;17(1):148. doi: 10.1186/S13059-016-1012-2.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Harrington et al., Recent developments and current status of gene therapy using viral vectors in the United Kingdom. BMJ. 2004;329(7470):839-842. doi:10.1136/bmj.329.7470.839.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Husimi, Selection and evolution of bacteriophages in cellstat. Adv Biophys. ; 1989;25:1-43. Review.
Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Kakiyama et al., A peptide release system using a photo-cleavable linker in a cell array format for cell-toxicity analysis. Polymer J. Feb. 27, 2013;45:535-9.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNAin mammalian cells. Nucleic Acids Res. Dec. 1, 2004;32(21):6200-11. Print 2004.
Komor et al., CRISPR-Based Technologies for the Manipulation of Eukaryotic Genomes. Cell. Jan. 12, 2017;168(1-2):20-36. doi: 10.1016/j.cell.2016.10.044.
Koonin et al., Diversity, classification and evolution of CRISPR-Cas systems. Curr Opin Microbiol. 2017;37:67-78. doi:10.1016/j.mib.2017.05.008.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kwon et al., Chemical basis of glycine riboswitch cooperativity. RNA. Jan. 2008;14(1):25-34. Epub Nov. 27, 2007.
Lee et al., An allosteric self-splicing ribozyme triggered by a bacterial second messenger. Science. Aug. 13, 2010;329(5993):845-8. doi: 10.1126/science.1190713.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal pone.0166020. eCollection 2016.
Lewis et al., Building the Class 2 CRISPR-Cas Arsenal. Mol Cell 2017;65(3);377-379.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Multiplex and homologous recombination-mediated genome editing in *Arabidopsis* and *Nicotiana benthamiana* using guide RNA and Cas9. Nat Biotechnol. Aug. 2013;31(8):688-91. doi: 10.1038/nbt.2654.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.

(56) References Cited

OTHER PUBLICATIONS

Lilley, D.M. The Varkud Satellite Ribozyme. RNA. Feb. 2004;10(2):151-8.doi: 10.1261/rna.5217104.
Liu et al., Balancing AID and DNA repair during somatic hypermutation. Trends Immunol. Apr. 2009;30(4):173-81. doi: 10.1016/j.it.2009.01.007.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Functional Nucleic Acid Sensors. Chem Rev. May 2009;109(5):1948-98. doi: 10.1021/cr030183i.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Meyer et al., Confirmation of a second natural preQ1 aptamer class in Streptococcaceae bacteria. RNA. Apr. 2008;14(4):685-95. doi: 10.1261/ma.937308. Epub Feb. 27, 2008.
Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem.5b01139. Epub Jan. 19, 2016.
Monahan et al., Site-specific incorporation of unnatural amino acids into receptors expressed in Mammalian cells. Chem Biol. Jun. 2003;10(6):573-80.
Montange et al., Structure of the S-adenosylmethionine riboswitch regulatory mRNA element. Nature. Jun. 29, 2006;441(7097):1172-5.
Mootz et al., Conditional protein splicing: a new tool to control protein structure and function in vitro and in vivo. J Am Chem Soc. Sep. 3, 2003; 125(35):10561-9.
Mootz et al., Protein splicing triggered by a small molecule. J Am Chem Soc. Aug. 7, 2002;124(31):9044-5.
Neel et al., Riboswitches: Classification, function and in silico approach, International Journal of Pharma Sciences and Research. 2010;1(9):409-420.
Nelson et al., Filamentous phage DNA cloning vectors: a noninfective mutant with a nonpolar deletion in gene III. Virology. 1981; 108(2): 338-50.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishimasu et al., Crystal Structure of *Staphylococcus aureus* Cas9. Cell. Aug. 27, 2015;162(5);1113-26. doi: 10.1016/j.cell.2015.08.007.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.
Oakes et al., Protein engineering of Cas9 for enhanced function. Methods Enzymol. 2014;546:491-511.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pelletier, CRISPR-Cas systems for the study of the immune function. Nov. 15, 2016. https://doi.org/10.1002/9780470015902.a0026896.
Plosky et al., CRISPR-Mediated Base Editing without DNA Double-Strand Breaks. Mol Cell. May 19, 2016;62(4):477-8. doi: 10.1016/j.molcel.2016.05.006.
Rakonjac et al., Roles of PIII in filamentous phage assembly. J Mol Biol. 1998; 282(1)25-41.

Ren et al., In-line Alignment and $Mg^{2+}$ Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Riechmann et al.,. The C-terminal domain of To1A is the coreceptor for filamentous phage infection of *E. coli*. Cell. 1997; 90(2):351-60. PMID:9244308.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Sharma et al., Efficient introduction of aryl bromide functionality into proteins in vivo. FEES Lett. Feb. 4, 2000;467(1):37-40.
Shee et al., Engineered proteins detect spontaneous DNA breakage in human and bacterial cells. Elife. Oct. 29, 2013;2:e01222. doi: 10.7554/eLife.01222.
Skretas et al., Regulation of protein activity with small-molecule-controlled inteins. Protein Sci. Feb. 2005;14(2):523-32. Epub Jan. 4, 2005.
Smitii, Filamentous fusion phage: novel expression vectors that display cloned antigens on the virion surface. Science. Jun. 14, 1985;228(4705):1315-7.
Sudarsan et al., An mRNA structure in bacteria that controls gene expression by binding lysine. Genes Dev. Nov. 1, 2003;17(21):2688-97.
Suess et al., A theophylline responsive riboswitch based on helix slipping controls gene expression in vivo. Nucleic Acids Res. Mar. 5, 2004;32(4):1610-4.
Tang et al., Aptazyme-embedded guide RNAs enable ligand-responsive genome editing and transcriptional activation. Nat Commun. Jun. 28, 2017;8:15939. doi: 10.1038/ncomms15939.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/ma.988608. Epub Mar. 27, 2008.
Wiesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wilson et al., In Vitro Selection of Functional Nucleic Acids. Annu Rev Biochem. 1999;68:611-47. doi: 10.1146/annurev.biochem.68.1.611.

(56) References Cited

OTHER PUBLICATIONS

Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamamoto et al., Virological and immunological bases for HIV-1 vaccine design. Uirusu 2007;57(2):133-139. https://doi.org/10.2222/jsv.57.133.
Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., New CRISPR-Cas systems discovered. Cell Res. Mar. 2017;27(3):313-314. doi: 10.1038/cr.2017.21. Epub Feb. 21, 2017.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yuan et al., Laboratory-directed protein evolution. Microbiol Mol Biol Rev. 2005; 69(3):373-92. PMID: 16148303.
Zhang et al., Ribozymes and Riboswitches: Modulation of RNA Function by Small Molecules. Biochemistry. Nov. 2, 2010;49(43):9123-31. doi: 10.1021/bi1012645.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Zimmermann et al., Molecular interactions and metal binding in the theophylline-binding core of an RNA aptamer. RNA. May 2000;6(5):659-67.
Partial European Search Report for Application No. EP 19187331.4, dated Dec. 19, 2019.
Extended European Search Report for EP 19187331.4, dated Mar. 25, 2020.
Extended European Search Report for EP18199195.1, dated Feb. 12, 2019.
Extended European Search Report for EP 19181479.7, dated Oct. 31, 2019.
International Search Report for PCT/US2018/025887, dated Jun. 21, 2018.
International Preliminary Report on Patentability for PCT/US2014/048390, dated Mar. 7, 2019.
International Preliminary Report on Patentability for PCT/US2017/068114, dated Jul. 4, 2019.
International Preliminary Report on Patentability for PCT/US2017/068105, dated Jul. 4, 2019.
International Search Report for PCT/US2018/021880, dated Jun. 20, 2018.
International Preliminary Report on Patentability for PCT/US2018/021880, dated Sep. 19, 2019.
International Preliminary Report on Patentability for PCT/US2017/046144, dated Feb. 21, 2019.
International Preliminary Report on Patentability for PCT/US2017/045381, dated Feb. 14, 2019.
International Search Report for PCT/US2018/021664, dated Jun. 21, 2018.
International Preliminary Report on Patentability for PCT/US2018/021664, dated Sep. 19, 2019.
International Preliminary Report on Patentability for PCT/US2017/056671, dated Apr. 25, 2019.
Invitation to Pay Additional Fees for PCT/US2018/021878, dated Jun. 8, 2018.
International Search Report for PCT/US2018/021878, dated Aug. 20, 2018.
International Preliminary Report on Patentability for PCT/US2018/021878, dated Sep. 19, 2019.
International Search Report for PCT/US2018/024208, dated Aug. 23, 2018.
International Preliminary Report on Patentability for PCT/US2018/024208, dated Oct. 3, 2019.
International Search Report for PCT/US2018/048969, dated Jul. 31, 2019.
International Preliminary Report on Patentability for PCT/US2018/048969, dated Mar. 12, 2020.
International Search Report for PCT/US2018/032460, dated Jul. 11, 2018.
International Preliminary Report on Patentability for PCT/US2018/032460, dated Nov. 21, 2019.
International Search Report and Written Opinion for PCT/US2018/044242, dated Nov. 21, 2019.
International Preliminary Report on Patentability for PCT/US2018/044242, dated Feb. 6, 2020.
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 16/860,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 30, 2019, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,891, filed Dec. 22, 2017, Maianti et al.
U.S. Appl. No. 16/626,436, filed Jul. 10, 2020, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 16/492,548, filed Sep. 9, 2019, Liu et al.
U.S. Appl. No. 15/784,033, filed Oct. 13, 2017, Liu et al.
U.S. Appl. No. 16/492,533, filed Sep. 9, 2019, Liu et al.
U.S. Appl. No. 16/643,376, filed Feb. 28, 2020, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/756,432, filed Apr. 15, 2020, Liu et al.

(56) References Cited

OTHER PUBLICATIONS

Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.
Budker et al., Protein/amphipathic polyamine complexes enable highly efficient transfection with minimal toxicity. Biotechniques. Jul. 1997;23(1):139, 142-7. doi: 10.2144/97231rr02.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Sun et al., The CRISPR/Cas9 system for gene editing and its potential application in pain research. Transl Periop & Pain Med. Aug. 3, 2016;1(3):22-33.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Yu et al., Liposome-mediated in vivo E1A gene transfer suppressed dissemination of ovarian cancer cells that overexpress HER-2/neu. Oncogene. Oct. 5, 1995;11(7):1383-8.
U.S. Appl. No. 17/160,329, filed Jan. 27, 2021, Liu et al.
U.S. Appl. No. 17/130,812, filed Dec. 22, 2020, Liu et al.
U.S. Appl. No. 17/148,059, filed Jan. 13, 2021, Liu et al.
U.S. Appl. No. 16/976,047, filed Aug. 26, 2020, Liu et al.
U.S. Appl. No. 17/289,665, filed Apr. 28, 2021, Liu et al.
U.S. Appl. No. 16/772,747, filed Jun. 12, 2020, Shen et al.
U.S. Appl. No. 17/425,261, filed Jul. 22, 2021, Kim et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al.
U.S. Appl. No. 17/288,504, filed Apr. 23, 2021, Liu et al.
U.S. Appl. No. 17/219,590, filed Mar. 31, 2021, Liu et al.
U.S. Appl. No. 17/219,635, filed Mar. 31, 2021, Liu et al.
U.S. Appl. No. 17/219,672, filed Mar. 31, 2021, Liu et al.
U.S. Appl. No. 17/294,287, filed May 14, 2021, Liu et al.
[No Author Listed] NCBI Accession No. XP_015843220.1. C →U editing enzyme APOBEC-1 [Peromyscus maniculatus bairdii], XP002793540.
[No Author Listed] NCBI Accession No. XP_021505673.1. C →U editing enzyme APOBEC-1 [Meriones unguiculatus], XP002793541.
Abremski et al., Bacteriophage P1 site-specific recombination. Purification and properties of the Cre recombinase protein. J Biol Chem. Feb. 10, 1984;259(3):1509-14.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Casl3. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.

Ahmad et al., Antibody-mediated specific binding and cytotoxicity of liposome-entrapped doxorubicin to lung cancer cells in vitro. Cancer Res. Sep. 1, 1992;52(17):4817-20.
Aik et al., Structure of human RNA N?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akinsheye et al., Fetal hemoglobin in sickle cell anemia. Blood. Jul. 7, 2011; 118(1):19-27. doi: 10.1182/blood-2011-03-325258. Epub Apr. 13, 2011.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known ?-gene mutations associated with hereditary persistence of fetal hemoglobin. Int J Lab Hematol. Feb. 2014;36(1):13-9. doi: 10.1111/ijlh.12094. Epub Apr. 29, 2013.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014:546:1-20.
Anderson, Human gene therapy. Science. May 8, 1992;256(5058):808-13. doi: 10.1126/science.1589762.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSRl. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity generating retroelement. Proc Natl Acad Sci U S A. May 14, 2013;110(20):8212-7. doi: 10.1073/pnas.1301366110. Epub Apr. 30, 2013.

(56) References Cited

OTHER PUBLICATIONS

Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.

Arbab et al., Cloning-free CRISPR. Stem Cell Reports. Nov. 10, 2015;5(5):908-917. doi: 10.1016/j.stemcr.2015.09.022. Epub Oct. 29, 2015.

Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.

Asante et al., A naturally occurring variant of the human prion protein completely prevents prion disease. Nature. Jun. 25, 2015;522(7557):478-81. doi: 10.1038/nature14510. Epub Jun. 10, 2015.

Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.

Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.

Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.

Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.

Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.

Badran et al., Continuous evolution of Bacillus thuringiensis toxins overcomes insect resistance. Nature. May 5, 2016;533(7601):58-63. doi: 10.1038/nature17938. Epub Apr. 27, 2016.

Badran et al., Development of potent in vivo mutagenesis plasmids with broad mutational spectra. Nat Commun. Oct. 7, 2015;6:8425. doi: 10.1038/ncomms9425.

Bae et al., Microhomology-based choice of Cas9 nuclease target sites. Nat Methods. Jul. 2014;11(7):705-6. doi: 10.1038/nmeth.3015.

Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.

Balakrishnan et al., Flap endonuclease 1. Annu Rev Biochem. 2013;82:119-38. doi: 10.1146/annurev-biochem-072511-122603. Epub Feb. 28, 2013.

Baldari et al., A novel leader peptide which allows efficient secretion of a fragment of human interleukin 1 beta in *Saccharomyces cerevisiae*. EMBO J. Jan. 1987;6(1):229-34.

Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.

Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.

Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.

Barnes et al., The fidelity of Taq polymerase catalyzing PCR is improved by an N-terminal deletion. Gene. Mar. 1, 1992;112(1):29-35. doi: 10.1016/0378-1119(92)90299-5.

Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.

Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.

Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.

Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.

Behr, Gene transfer with synthetic cationic amphiphiles: prospects for gene therapy. Bioconjug Chem. Sep.-Oct. 1994;5(5):382-9. doi: 10.1021/bc00029a002.

Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.

Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.

Bennett et al., Painful and painless channelopathies. Lancet Neurol. Jun. 2014;13(6):587-99. doi: 10.1016/S1474-4422(14)70024-9. Epub May 6, 2014.

Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.

Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.

Bernhart et al., Local RNA base pairing probabilities in large sequences. Bioinformatics. Mar. 1, 2006;22(5):614-5. doi: 10.1093/bioinformatics/btk014. Epub Dec. 20, 2005.

Bernstein et al., Role for a bidentate ribonuclease in the initiation step of RNA interference. Nature. Jan. 18, 2001;409(6818):363-6. doi: 10.1038/35053110.

Bertolotti et al., Toward genosafe endonuclease-boosted gene targeting using breakthrough CRISP/Cas9 for next generation stem cell gene therapy culminating in efficient ex Vivo in Vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.

Bertrand et al., Localization of ASH1 mRNA particles in living yeast. Mol Cell. Oct. 1998;2(4):437-45. doi: 10.1016/s1097-2765(00)80143-4.

Bessen et al., High-resolution specificity profiling and off-target prediction for site-specific DNA recombinases. Nat Commun. Apr. 26, 2019;10(1):1937. doi: 10.1038/s41467-019-09987-0.

Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.

Bibb et al., Integration and excision by the large serine recombinase phiRvl integrase. Mol Microbiol. Mar. 2005;55(6):1896-910. doi: 10.1111/j.1365-2958.2005.04517.x.

Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.

Biswas et al., A structural basis for allosteric control of DNA recombination by lambda integrase. Nature. Jun. 23, 2005;435(7045):1059-66. doi: 10.1038/nature03657.

Blaese et al., Vectors in cancer therapy: how will they deliver? Cancer Gene Ther. Dec. 1995;2(4):291-7.

(56) References Cited

OTHER PUBLICATIONS

Blain et al., Nuclease activities of Moloney murine leukemia virus reverse transcriptase. Mutants with altered substrate specificities. J Biol Chem. Nov. 5, 1993;268(31):23585-92.

Blaisonneau et al., A circular plasmid from the yeast *Torulaspora delbrueckii*. Plasmid. 1997;38(3):202-9. doi: 10.1006/plas.1997.1315.

Blau et al., A proliferation switch for genetically?modified?cells. PNAS Apr. 1, 1997 94 (7)3076-3081; https://doi.org/10.1073/pnas.94.7.3076.

Bloom et al., Evolving strategies for enzyme engineering. Curr Opin Struct Biol. Aug. 2005;15(4):447-52.

Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.

Boersma et al., Selection strategies for improved biocatalysts. FEBS J. May 2007;274(9):2181-95.

Bogdanove et al., Engineering altered protein-DNA recognition specificity. Nucleic Acids Res. Jun. 1, 2018;46(10):4845-4871. doi: 10.1093/nar/gky289.

Bolusani et al., Evolution of variants of yeast site-specific recombinase Flp that utilize native genomic sequences as recombination target sites. Nucleic Acids Res. 2006;34(18):5259-69. Epub Sep. 26, 2006.

Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.

Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.

Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.

Box et al., A multi-domain protein system based on the HC fragment of tetanus toxin for targeting DNA to neuronal cells. J Drug Target. Jul. 2003;11(6):333-43. doi: 10.1080/1061186310001634667.

Braun et al., Immunogenic duplex nucleic acids are nuclease resistant. J Immunol. Sep. 15, 1988;141(6):2084-9.

Brown et al., A mammalian protein targeted by G1-arresting rapamycin-receptor complex. Nature. Jun. 30, 1994;369(6483):756-8. doi: 10.1038/369756a0.

Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.

Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.

Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.

Buchschacher et al., Human immunodeficiency virus vectors for inducible expression of foreign genes. J Virol. May 1992;66(5):2731-9. doi: 10.1128/JVI.66.5.2731-2739.1992.

Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.

Budworth et al., A brief history of triplet repeat diseases. Methods Mol Biol. 2013;1010:3-17. doi: 10.1007/978-1-62703-411-1_1.

Buskirk et al., In vivo evolution of an RNA-based transcriptional activator. Chem Biol. Jun. 2003;10(6):533-40. doi: 10.1016/s1074-5521(03)00109-1.

Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.

Cadwell et al., Randomization of genes by PCR mutagenesis. PCR Methods Appl. Aug. 1992;2(1):28-33. doi: 10.1101/gr.2.1.28.

Cai et al., Reconstruction of ancestral protein sequences and its applications. BMC Evol Biol. Sep. 17, 2004;4:33. doi: 10.1186/1471-2148-4-33.

Calame et al., Transcriptional controlling elements in the immunoglobulin and T cell receptor loci. Adv Immunol. 1988;43:235-75. doi: 10.1016/s0065-2776(08)60367-3.

Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.

Camper et al., Postnatal repression of the alpha-fetoprotein gene is enhancer independent. Genes Dev. Apr. 1989;3(4):537-46. doi: 10.1101/gad.3.4.537.

Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.

Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.

Canver et al., Customizing the genome as therapy for the ?-hemoglobinopathies. Blood. May 26, 2016;127(21):2536-45. doi: 10.1182/blood-2016-01-678128. Epub Apr. 6, 2016.

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Carr et al., Genome engineering. Nat Biotechnol. Dec. 2009;27(12):1151-62. doi: 10.1038/nbt.1590.

Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.

Caspi et al., Distribution of split DnaE inteins in cyanobacteria. Mol Microbiol. Dec. 2003;50(5):1569-77. doi: 10.1046/j.1365-2958.2003.03825.x.

Cattaneo et al., SEL1L affects human pancreatic cancer cell cycle and invasiveness through modulation of PTEN and genes related to cell-matrix interactions. Neoplasia. 2005;7(11):1030-1038.

Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chan et al., Novel selection methods for DNA-encoded chemical libraries. Curr Opin Chem Biol. 2015;26:55-61. doi: 10.1016/j.cbpa.2015.02.010.

Chapman et al., Playing the end game: DNA double-strand break repair pathway choice. Mol Cell. Aug. 24, 2012;47(4):497-510. doi: 10.1016/j.molcel.2012.07.029.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chen et al., Enhanced proofreading governs CRISPR-Cas9 targeting accuracy. Nature. Oct. 19, 2017;550(7676):407-410. doi: 10.1038/nature24268. Epub Sep. 20, 2017.

(56) References Cited

OTHER PUBLICATIONS

Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chin, Expanding and reprogramming the genetic code of cells and animals. Annu Rev Biochem. 2014;83:379-408. doi: 10.1146/annurev-biochem-060713-035737. Epub Feb. 10, 2014.
Cho et al., Site-specific recombination of bacteriophage P22 does not require integration host factor. J Bacteriol. Jul. 1999;181(14):4245-9. doi: 10.1128/JB.181.14.4245-4249.1999.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite *Nanoarchaeum equitans*. J Mol Biol. Mar. 10, 2006;356(5):1093-106. doi: 10.1016/j.jmb.2005.12.036. Epub Dec. 27, 2005.
Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.

Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Collinge, Prion diseases of humans and animals: their causes and molecular basis. Annu Rev Neurosci. 2001;24:519-50. doi: 10.1146/annurev.neuro.24.1.519.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework:? A Protein Biosensor. J. Am. Chem. Soc. Jan. 22, 1999; 121(5):1100-1. https://doi.org/10.1021/ja983804b.
Cox et al., RNA editing with CRISPR-Cas13. Science. Nov. 24, 2017;358(6366):1019-1027. doi: 10.1126/science.aaq0180. Epub Oct. 25, 2017.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Crick, On protein synthesis. Symp Soc Exp Biol. 1958;12:138-63.
Crystal, Transfer of genes to humans: early lessons and obstacles to success. Science. Oct. 20, 1995;270(5235):404-10. doi: 10.1126/science.270.5235.404.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cupples et al., A set of lacZ mutations in *Escherichia coli* that allow rapid detection of each of the six base substitutions. Proc Natl Acad Sci U S A. Jul. 1989;86(14):5345-9.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dang et al., Optimizing sgRNA structure to improve CRISPR-Cas9 knockout efficiency. Genome Biol. Dec. 15, 2015;16:280. doi: 10.1186/s13059-015-0846-3.
Das et al.,The crystal structure of the monomeric reverse transcriptase from Moloney murine leukemia virus. Structure. May 2004;12(5):819-29. doi: 10.1016/j.str.2004.02.032.

(56) References Cited

OTHER PUBLICATIONS

Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.

Dassa et al., Trans protein splicing of cyanobacterial split inteins in endogenous and exogenous combinations. Biochemistry. Jan. 9, 2007;46(1):322-30. doi: 10.1021/bi0611762.

Datsenko et al., One-step inactivation of chromosomal genes in *Escherichia coli* K-12 using PCR products. Proc Natl Acad Sci U S A. Jun. 6, 2000;97(12):6640-5.

De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.

De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.

Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.

DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.

Delebecque et al., Organization of intracellular reactions with rationally designed RNA assemblies. Science. Jul. 22, 2011;333(6041):470-4. doi: 10.1126/science.1206938. Epub Jun. 23, 2011.

Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.

Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.

Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.

Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.

Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.

Dickey et al., Single-stranded DNA-binding proteins: multiple domains for multiple functions. Structure. Jul. 2, 2013;21(7):1074-84. doi: 10.1016/j.str.2013.05.013.

Dickinson et al., Experimental interrogation of the path dependence and stochasticity of protein evolution using phage-assisted continuous evolution. Proc Natl Acad Sci U S A. May 2013;110(22):9007-12.

Dillon, Regulating gene expression in gene therapy. Trends Biotechnol. May 1993;11(5):167-73. doi: 10.1016/0167-7799(93)90109-M.

Dingwall et al., Nuclear targeting sequences—a consensus? Trends Biochem Sci. Dec. 1991;16(12):478-81. doi: 10.1016/0968-0004(91)90184-w.

Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.

Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.

Dominissini et al., Topology of the human and mouse m6A RNA methylomes revealed by m6A-seq. Nature. Apr. 29, 2012;485(7397):201-6. doi: 10.1038/nature11112.

Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.

Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.

Dove et al., Conversion of the omega subunit of *Escherichia coli* RNA polymerase into a transcriptional activator or an activation target. Genes Dev. Mar. 1, 1998;12(5):745-54.

Doyon et al., Directed evolution and substrate specificity profile of homing endonuclease I-SceI. J Am Chem Soc. Feb. 22, 2006;128(7):2477-84.

Drake, A constant rate of spontaneous mutation in DNA-based microbes. Proc Natl Acad Sci U S A. Aug. 15, 1991;88(16):7160-4.

Dubois et al., Retroviral RNA Dimerization: From Structure to Functions. Front Microbiol. Mar. 22, 2018;9:527. doi: 10.3389/fmicb.2018.00527.

Dunbar et al., Gene therapy comes of age. Science. Jan. 12, 2018;359(6372):eaan4672. doi: 10.1126/science.aan4672.

Dupuy et al., Le syndrome de De La Chapelle [De La Chapelle syndrome]. Presse Med. Mar. 3, 2001;30(8):369-72. French.

Durai et al., A bacterial one-hybrid selection system for interrogating zinc finger-DNA interactions. Comb Chem High Throughput Screen. May 2006;9(4):301-11.

Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.

Edlund et al., Cell-specific expression of the rat insulin gene: evidence for role of two distinct 5' flanking elements. Science. Nov. 22, 1985;230(4728):912-6. doi: 10.1126/science.3904002.

Eick et al., Robustness of Reconstructed Ancestral Protein Functions to Statistical Uncertainty. Mol Biol Evol. Feb. 1, 2017;34(2):247-261. doi: 10.1093/molbev/msw223.

Engel et al., The emerging role of mRNA methylation in normal and pathological behavior. Genes Brain Behav. Mar. 2018;17(3):e12428. doi: 10.1111/gbb.12428. Epub Nov. 17, 2017.

Engelward et al., Base excision repair deficient mice lacking the Aag alkyladenine DNA glycosylase. Proc Natl Acad Sci U S A. Nov. 25, 1997;94(24):13087-92.

England, Unnatural amino acid mutagenesis: a precise tool for probing protein structure and function. Biochemistry. Sep. 21, 2004;43(37):11623-9.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.

Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

(56) References Cited

OTHER PUBLICATIONS

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Fawcett et al., Transposable elements controlling I-R hybrid dysgenesis in D. melanogaster are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

Feng et al., Human L1 retrotransposon encodes a conserved endonuclease required for retrotransposition. Cell. Nov. 29, 1996;87(5):905-16. doi: 10.1016/s0092-8674(00)81997-2.

Feuk, Inversion variants in the human genome: role in disease and genome architecture. Genome Med. Feb. 12, 2010;2(2):11. doi: 10.1186/gm132.

Filippov et al., A novel type of RNase III family proteins in eukaryotes. Gene. Mar. 7, 2000;245(1):213-21. doi: 10.1016/s0378-1119(99)00571-5.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007; 104(29):11951-6. doi: 10.1073/pnas.0705348104. Epub Jul. 9, 2007.

Fitzjohn, Diversitree: comparative phylogenetic analyses of diversification in R. Methods in Evology and Evolution. Dec. 2012;3(6):1084-92 .doi: 10.1111/j.2041-210X.2012.00234.x.

Flajolet et al., Woodchuck hepatitis virus enhancer I and enhancer II are both involved in N-myc2 activation in woodchuck liver tumors. J Virol. Jul. 1998;72(7):6175-80. doi: 10.1128/JVI.72.7.6175-6180.1998.

Flaman et al., A rapid PCR fidelity assay. Nucleic Acids Res. Aug. 11, 1994;22(15):3259-60. doi: 10.1093/nar/22.15.3259.

Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.

Fogg et al., New applications for phage integrases. J Mol Biol. Jul. 29, 2014;426(15):2703-16. doi: 10.1016/j.jmb.2014.05.014. Epub May 22, 2014.

Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.

Forster et al., Self-cleavage of virusoid RNA is performed by the proposed 55-nucleotide active site. Cell. Jul. 3, 1987;50(1):9-16. doi: 10.1016/0092-8674(87)90657-x.

Fouts et al., Sequencing Bacillus anthracis typing phages gamma and cherry reveals a common ancestry. J Bacteriol. May 2006;188(9):3402-8. doi: 10.1128/JB.188.9.3402-3408.2006.

Freitas et al., Mechanisms and signals for the nuclear import of proteins. Curr Genomics. Dec. 2009;10(8):550-7. doi: 10.2174/138920209789503941.

Fu et al., Promises and Pitfalls of Intracellular Delivery of Proteins. Bioconjugate Chemistry. Aug. 2014;25:1602-8.

Furukawa et al., In vitro selection of allosteric ribozymes that sense the bacterial second messenger c-di-GMP. Methods Mol Biol. 2014;1111:209-20. doi: 10.1007/978-1-62703-755-6_15.

Gaj et al., 3rd. Genome engineering with custom recombinases. Methods Enzymol. 2014;546:79-91. doi: 10.1016/B978-0-12-801185-0.00004-0.

Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.

Gao et al., Cationic liposome-mediated gene transfer. Gene Ther. Dec. 1995;2(10):710-22.

Gao et al., Prime editing in mice reveals the essentiality of a single base in driving tissue-specific gene expression. Genome Biol. Mar. 16, 2021;22(1):83. doi: 10.1186/s13059-021-02304-3.

Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.

Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.

Gapinske et al., CRISPR-SKIP: programmable gene splicing with single base editors. Genome Biol. Aug. 15, 2018;19(1):107. doi: 10.1186/s13059-018-1482-5.

Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.

Garibyan et al., Use of the rpoB gene to determine the specificity of base substitution mutations on the Escherichia coli chromosome. DNA Repair (Amst). May 13, 2003;2(5):593-608.

Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.

Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.

Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.

GenBank Accession No. J01600.1. Brooks et al., E.coli dam gene coding for DNA adenine methylase. Apr. 26, 1993.

GenBank Accession No. U07651.1. Lu, Escherichia coli K12 negative regulator of replication initiation (seqA) gene, complete cds. Jul. 19, 1994.

GenBank Submission; NIH/NCBI, Accession No. AAA66622.1. Martinelli et al., May 18, 1995. 2 pages.

GenBank Submission; NIH/NCBI, Accession No. AGT42196. Farzadfar et al., Nov. 2, 2013. 2 pages.

GenBank Submission; NIH/NCBI, Accession No. APG80656.1. Burstein et al., Dec. 10, 2016. 1 pages.

GenBank Submission; NIH/NCBI, Accession No. AYD60528.1. Ram et al., Oct. 2, 2018. 1 page.

GenBank Submission; NIH/NCBI, Accession No. KR710351.1. Sahni et al., Jun. 1, 2015. 2 pages.

GenBank Submission; NIH/NCBI, Accession No. NP_955579.1. Chen et al., Aug. 13, 2018. 5 pages.

GenBank Submission; NIH/NCBI, Accession No. RFF81513.1. Zhou et al., Aug. 21, 2018. 2 pages.

GenBank Submission; NIH/NCBI, Accession No. SNX31424.1. Weckx, S., Feb. 16, 2018. 2 pages.

GenBank Submission; NIH/NCBI, Accession No. TGH57013. Xu et al., Apr. 9, 2019. 2 pages.

GenBank Submission; NIH/NCBI, Accession No. WP_031386437. No Author Listed., Sep. 23, 2019. 1 page.

GenBank Submission; NIH/NCBI, Accession No. WP_031589969.1. Haft et al., Oct. 9, 2019. 2 pages.

GenBank Submission; NIH/NCBI, Accession No. WP_044924278.1. Haft et al., Oct. 9, 2019. 2 pages.

(56) References Cited

OTHER PUBLICATIONS

GenBank Submission; NIH/NCBI, Accession No. WP_047338501. 1. Haft et al., Oct. 9, 2019. 2 pages.
GenBank Submission; NIH/NCBI, Accession No. WP_060798984. 1. Haft et al., Oct. 9, 2019. 2 pages.
GenBank Submission; NIH/NCBI, Accession No. WP_062913273. 1. Haft et al., Oct. 9, 2019, 2 pages.
GenBank Submission; NIH/NCBI, Accession No. WP_072754838. No Author Listed., Sep. 23, 2019. 1 page.
GenBank Submission; NIH/NCBI, Accession No. WP_095142515. 1. No Author Listed., Sep. 23, 2019. 1 page.
GenBank Submission; NIH/NCBI, Accession No. WP_118538418. 1. No Author Listed., Oct. 13, 2019. 1 page.
GenBank Submission; NIH/NCBI, Accession No. WP_119223642. 1. No Author Listed., Oct. 13, 2019. 1 page.
GenBank Submission; NIH/NCBI, Accession No. WP_119227726. 1. No Author Listed., Oct. 13, 2019. 1 page.
GenBank Submission; NIH/NCBI, Accession No. WP_119623382. 1. No Author Listed., Oct. 13, 2019. 1 page.
GenBank Submission; NIH/NCBI, Accession No. WP_132221894. 1. No Author Listed., Sep. 23, 2019. 1 page.
GenBank Submission; NIH/NCBI, Accession No. WP_133478044. 1. Haft et al., Oct. 9, 2019. 2 pages.
GenBank Submission; NIH/NCBI, Accession No. YP_009283008. 1. Bernardini et al., Sep. 23, 2016. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Gong et al., Active DNA demethylation by oxidation and repair. Cell Res. Dec. 2011;21(12):1649-51. doi: 10.1038/cr.2011.140. Epub Aug. 23, 2011.
Goodnough et al., Development of a delivery vehicle for intracellular transport of botulinum neurotoxin antagonists. FEBS Lett. Feb. 27, 2002;513(2-3):163-8.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBTl and development of sitespecific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/GB-2001-2-6-reviews1017. Epub Jun. 5, 2001.
Grishok et al., Genes and Mechanisms Related to RNA Interference Regulate Expression of the Small Temporal RNAs that Control C. elegans Developmental Timing. Jul. 13, 2001:106(1):P23-4.
Groth et al., Construction of transgenic *Drosophila* by using the site-specific integrase from phage phiC31. Genetics. Apr. 2004;166(4):1775-82. doi: 10.1534/genetics.166.4.1775.
Gruber et al., Strategies for measuring evolutionary conservation of RNA secondary structures. BMC Bioinformatics. Feb. 26, 2008;9:122. doi: 10.1186/1471-2105-9-122.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Facile functionalization of FK506 for biological studies by the thiol-ene 'click' reaction. RSC Advances. 2014;22:11400-3.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanna et al., Massively parallel assessment of human variants with base editor screens. Cell. Feb. 18, 2021;184(4):1064-1080.e20. doi: 10.1016/j.cell.2021.01.012.

(56) References Cited

OTHER PUBLICATIONS

Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.

Harms et al., Evolutionary biochemistry: revealing the historical and physical causes of protein properties. Nat Rev Genet. Aug. 2013;14(8):559-71. doi: 10.1038/nrg3540.

Harrington et al., A thermostable Cas9 with increased lifetime in human plasma. Nat Commun. Nov. 10, 2017;8(1):1424. doi: 10.1038/s41467-017-01408-4.

Hasegawa et al., Spontaneous mutagenesis associated with nucleotide excision repair in Escherichia coli. Genes Cells. May 2008;13(5):459-69. doi: 10.1111/j.1365-2443.2008.01185.x.

Hector et al., CDKL5 variants: Improving our understanding of a rare neurologic disorder. Neurol Genet. Dec. 15, 2017;3(6):e200. doi: 10.1212/NXG.0000000000000200.

Heidenreich et al., Non-homologous end joining as an important mutagenic process in cell cycle-arrested cells. EMBO J. May 1, 2003;22(9):2274-83. doi: 10.1093/emboj/cdg203.

Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.

Hendricks et al., The S. cerevisiae Mag1 3-methyladenine DNA glycosylase modulates susceptibility to homologous recombination. DNA Repair (Amst). 2002;1(8):645-659.

Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.

Herschhorn et al., Retroviral reverse transcriptases. Cell Mol Life Sci. Aug. 2010;67(16):2717-47. doi: 10.1007/s00018-010-0346-2. Epub Apr. 1, 2010.

Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.

Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.

Hille et al., The Biology of CRISPR-Cas: Backward and Forward. Cell. Mar. 8, 2018;172(6):1239-1259. doi: 10.1016/j.cell.2017.11.032.

Hoang et al., UFBoot2: Improving the Ultrafast Bootstrap Approximation. Mol Biol Evol. Feb. 1, 2018;35(2):518-522. doi: 10.1093/molbev/msx281.

Hoernes et al., Translating the epitranscriptome. Wiley Interdiscip Rev RNA. Jan. 2017;8(1):e1375. doi: 10.1002/wrna.1375. Epub Jun. 27, 2016.

Hollis et al., Phage integrases for the construction and manipulation of transgenic mammals. Reprod Biol Endocrinol. Nov. 7, 2003;1:79. doi: 10.1186/1477-7827-1-79.

Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.

Hoogenboom et al., Natural and designer binding sites made by phage display technology. Immunol Today. Aug. 2000;21(8):371-8.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.

Huggins et al., Flap endonuclease 1 efficiently cleaves base excision repair and DNA replication intermediates assembled into nucleosomes. Mol Cell. Nov. 2002;10(5):1201-11. doi: 10.1016/81097-2765(02)00736-0.

Hung et al., Protein localization in disease and therapy. J Cell Sci. Oct. 15, 2011;124(Pt 20):3381-92. doi: 10.1242/jcs.089110.

Hwang et al., Web-based design and analysis tools for CRISPR base editing. BMC Bioinformatics. Dec. 27, 2018;19(1):542. doi: 10.1186/s12859-018-2585-4.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in Escherichia coli phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid pl5B of Escherichia coli 15T-: a new member of the Din family of site-specific recombinases. Mol Microbiol. Jun. 1990;4(6):991-7. doi: 10.1111/j.1365-2958.1990.tb00671.x.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Jaffrey et al., Emerging links between m6A and misregulated mRNA methylation in cancer. Genome Med. Jan. 12, 2017;9(1):2. doi: 10.1186/s13073-016-0395-8.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jasin et al., Repair of strand breaks by homologous recombination. Cold Spring Harb Perspect Biol. Nov. 1, 2013;5(11):a012740. doi: 10.1101/cshperspect.a012740.

Jeggo, DNA breakage and repair. Adv Genet. 1998;38:185-218. doi: 10.1016/s0065-2660(08)60144-3.

Jemielity et al., Novel "anti-reverse" cap analogs with superior translational properties. RNA. Sep. 2003;9(9):1108-22. doi: 10.1261/rna.5430403.

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.

Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.

(56) References Cited

OTHER PUBLICATIONS

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

Johns et al., The promise and peril of continuous in vitro evolution. J Mol Evol. Aug. 2005;61(2):253-63. Epub Jun. 27, 2005.

Joho et al., Identification of a region of the bacteriophage T3 and T7 RNA polymerases that determines promoter specificity. J Mol Biol. Sep. 5, 1990;215(1):31-9.

Joyce et al., Amplification, mutation and selection of catalytic RNA. Gene. Oct. 15, 1989;82(1):83-7. doi: 10.1016/0378-1119(89)90033-4.

Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.

Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.

Kahmann et al., G inversion in bacteriophage Mu DNA is stimulated by a site within the invertase gene and a host factor. Cell. Jul. 1985;41(3):771-80. doi: 10.1016/s0092-8674(85)80058-1.

Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.

Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

Karimova et al., Discovery of Nigri/nox and Panto/pox site-specific recombinase systems facilitates advanced genome engineering. Sci Rep. Jul. 22, 2016;6:30130. doi: 10.1038/srep30130.

Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.

Kaufman et al., Translational efficiency of polycistronic mRNAs and their utilization to express heterologous genes in mammalian cells. EMBO J. Jan. 1987;6(1):187-93.

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Keijzers et al., Human exonuclease 1 (EXO1) activity characterization and its function on flap structures. Biosci Rep. Apr. 25, 2015;35(3):e00206. doi: 10.1042/BSR20150058.

Kelman, PCNA: structure, functions and interactions. Oncogene. Feb. 13, 1997;14(6):629-40. doi: 10.1038/sj.onc.1200886.

Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.

Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.

Kim et al., DJ-1, a novel regulator of the tumor suppressor PTEN. Cancer Cell. 2005;7(3):263-273.

Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.

Kim et al., An anionic human protein mediates cationic liposome delivery of genome editing proteins into mammalian cells. Nat Commun. Jul. 2, 2019;10(1):2905. doi: 10.1038/s41467-019-10828-3.

Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.

Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.

Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.

Kim et al., In vivo high-throughput profiling of CRISPR-Cpf1 activity. Nat Methods. Feb. 2017;14(2):153-159. doi: 10.1038/nmeth.4104. Epub Dec. 19, 2016.

Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.

Kim et al., Rescue of high-specificity Cas9 variants using sgRNAs with matched 5' nucleotides. Genome Biol. Nov. 15, 2017;18(1):218. doi: 10.1186/s13059-017-1355-3.

Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.

Klapacz et al., Frameshift mutagenesis and micro satellite instability induced by human alkyladenine DNA glycosylase. Mol Cell. Mar. 26, 2010;37(6):843-53. doi: 10.1016/j.molcel.2010.01.038.

Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.

Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.

Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.

Knott et al., Guide-bound structures of an RNA-targeting A-cleaving CRISPR-Cas 13a enzyme. Nat Struct Mol Biol. Oct. 2017;24(10):825-833. doi: 10.1038/nsmb.3466. Epub Sep. 11, 2017.

Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.

Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.

Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.

(56) References Cited

OTHER PUBLICATIONS

Kolot et al., Site-specific recombination in mammalian cells expressing the Int recombinase of bacteriophage HK022. Mol Biol Rep. Aug. 1999;26(3):207-13. doi: 10.1023/a:1007096701720.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988; 16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krokan et al., Uracil in DNA—occurrence, consequences and repair. Oncogene. Dec. 16, 2002;21(58):8935-48. doi: 10.1038/sj.onc.1205996.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.
Kunkel et al., Eukaryotic Mismatch Repair in Relation to DNA Replication. Annu Rev Genet. 2015;49:291-313. doi: 10.1146/annurev-genet-112414-054722.
Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.
Kuscu et al., CRISPR-Cas9-AID base editor is a powerful gain-of-function screening tool. Nat Methods. Nov. 29, 2016;13(12):983-984. doi: 10.1038/nmeth.4076.
Kwart et al., Precise and efficient scarless genome editing in stem cells using CORRECT. Nat Protoc. Feb. 2017;12(2):329-354. doi: 10.1038/nprot.2016.171. Epub Jan. 19, 2017.
Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.
Lada et al., Mutator effects and mutation signatures of editing deaminases produced in bacteria and yeast. Biochemistry (Mosc). Jan. 2011;76(1):131-46.
Lakich et al., Inversions disrupting the factor VIII gene are a common cause of severe haemophilia A. Nat Genet. Nov. 1993;5(3):236-41. doi: 10.1038/ng1193-236.
Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.
Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leaver-Fay et al., ROSETTA3: an object-oriented software suite for the simulation and design of macromolecules. Methods Enzymol. 2011;487:545-74. doi: 10.1016/B978-0-12-381270-4.00019-6.
Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.
Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.
Lee et al., Simultaneous targeting of linked loci in mouse embryos using base editing. Sci Rep. Feb. 7, 2019;9(1):1662. doi: 10.1038/s41598-018-33533-5.
Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.
Lee et al., Synthetically modified guide RNA and donor DNA are a versatile platform for CRISPR-Cas9 engineering. Elife. May 2, 2017;6:e25312. doi: 10.7554/eLife.25312.
Lee et al., Targeted chromosomal deletions in human cells using zinc finger nucleases. Genome Res. Jan. 20, 2010:81-89; Published in Advance Dec. 1, 2009, doi:10.1101/gr.099747.109.
Lee et al., Targeting fidelity of adenine and cytosine base editors in mouse embryos. Nat Commun. Nov. 15, 2018;9(1):4804. doi: 10.1038/s41467-018-07322-7.
Lee et al., Transcriptional regulation and its misregulation in disease. Cell. Mar. 14, 2013;152(6):1237-51. doi: 10.1016/j.cell.2013.02.014.
Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.
Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.
Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.
Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.
Lew et al., Protein splicing in vitro with a semisynthetic two-component minimal intein. J Biol Chem. Jun. 26, 1998;273(26):15887-90. doi: 10.1074/jbc.273.26.15887.
Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

(56) References Cited

OTHER PUBLICATIONS

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.

Li et al., Loss of post-translational modification sites in disease. Pac Symp Biocomput. 2010:337-47. doi: 10.1142/9789814295291_0036.

Li et al., Protein trans-splicing as a means for viral vector-mediated in vivo gene therapy. Hum Gene Ther. Sep. 2008;19(9):958-64. doi: 10.1089/hum.2008.009.

Li et al., RSEM: accurate transcript quantification from RNA-Seq data with or without a reference genome. BMC Bioinformatics. Aug. 4, 2011;12:323. doi: 10.1186/1471-2105-12-323.

Liang et al., Correction of ?-thalassemia mutant by base editor in human embryos. Protein Cell. Nov. 2017;8(11):811-822. doi: 10.1007/s13238-017-0475-6. Epub Sep. 23, 2017.

Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.

Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.

Lim et al., Crystal structure of the moloney murine leukemia virus RNase H domain. J Virol. Sep. 2006;80(17):8379-89. doi: 10.1128/JVI.00750-06.

Lin et al., Prime genome editing in rice and wheat. Nat Biotechnol. May 2020;38(5):582-585. doi: 10.1038/s41587-020-0455-x. Epub Mar. 16, 2020.

Liu et al., Split dnaE genes encoding multiple novel inteins in Trichodesmium erythraeum. J Biol Chem. Jul. 18, 2003;278(29):26315-8. doi: 10.1074/jbc.C300022200. Epub May 24, 2003.

Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.

Liu et al., Adding new chemistries to the genetic code. Annu Rev Biochem. 2010;79:413-44. doi: 10.1146/annurev.biochem.052308.105824.

Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.

Liu et al., Computational approaches for effective CRISPR guide RNA design and evaluation. Comput Struct Biotechnol J. Nov. 29, 2019;18:35-44. doi: 10.1016/j.csbj.2019.11.006.

Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.

Liu et al., Editing DNA Methylation in the Mammalian Genome. Cell. Sep. 22, 2016;167(1):233-247.e17. doi: 10.1016/j.cell.2016.08.056.

Liu et al., Flap endonuclease 1: a central component of DNA metabolism. Annu Rev Biochem. 2004;73:589-615. doi: 10.1146/annurev.biochem.73.012803.092453.

Liu et al., Genetic incorporation of unnatural amino acids into proteins in mammalian cells. Nat Methods. Mar. 2007;4(3):239-44. Epub Feb. 25, 2007.

Liu et al., Highly efficient RNA-guided base editing in rabbit. Nat Commun. Jul. 13, 2018;9(1):2717. doi: 10.1038/s41467-018-05232-2.

Liu et al., N(6)-methyladenosine-dependent RNA structural switches regulate RNA-protein interactions. Nature. Feb. 26, 2015;518(7540):560-4. doi: 10.1038/nature14234.

Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.

Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.

Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Lynch, Evolution of the mutation rate. Trends Genet. Aug. 2010;26(8):345-52. doi: 10.1016/j.tig.2010.05.003. Epub Jun. 30, 2010.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(Ala) with different anticodons. Biochemistry. Aug. 10, 1993;32(31):7939-45.

(56) References Cited

OTHER PUBLICATIONS

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.

Macbeth et al., Inositol hexakisphosphate is bound in the ADAR2 core and required for RNA editing. Science. Sep. 2, 2005;309(5740):1534-9. doi: 10.1126/science.1113150.

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.

Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.

Maji et al., A High-Throughput Platform to Identify Small-Molecule Inhibitors of CRISPR-Cas9. Cell. May 2, 2019;177(4):1067-1079. e19. doi: 10.1016/j.cell.2019.04.009.

Makarova et al., Classification and Nomenclature of CRISPR-Cas Systems: Where from Here? CRISPR J. Oct. 2018;1(5):325-336. doi: 10.1089/crispr.2018.0033.

Makeyev et al., Evolutionary potential of an RNA virus. J Virol. Feb. 2004;78(4):2114-20.

Malashkevich et al., Crystal structure of tRNA adenosine deaminase Tad A from *Escherichia coli*. Deposited: Mar. 10, 2005 Released: Feb. 21, 2006 doi:10.2210/pdb1z3a/pdb (2006).

Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.

Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.

Marceau, Functions of single-strand DNA-binding proteins in DNA replication, recombination, and repair. Methods Mol Biol. 2012;922:1-21. doi: 10.1007/978-1-62703-032-8_1.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Marquart et al., Predicting base editing outcomes with an attention-based deep learning algorithm trained on high-throughput target library screeen. bioRxiv. Jul. 5, 2020. DOI:10.1101/2020.07.05. 186544. Retrieved from the Internet via https://www.biorxiv.org/content/10.1101/2020.07.05.186544v1.full.pdf lased accessed on Apr. 28, 2021.

Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.

Martsolf et al., Complete trisomy 17p a relatively new syndrome. Ann Genet. 1988;31(3):172-4.

Mascola et al., HIV-1 neutralizing antibodies: understanding nature's pathways. Immunol Rev. Jul. 2013;254(1):225-44. doi: 10.1111/imr. 12075.

Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

McCarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

McInerney et al., Error Rate Comparison during Polymerase Chain Reaction by DNA Polymerase. Mol Biol Int. 2014;2014:287430. doi: 10.1155/2014/287430. Epub Aug. 17, 2014.

McKenna et al., Recording development with single cell dynamic lineage tracing. Development. Jun. 27, 2019;146(12):dev169730. doi: 10.1242/dev.169730.

McKenna et al., Whole-organism lineage tracing by combinatorial and cumulative genome editing. Science. Jul. 29, 2016;353(6298):aaf7907. doi: 10.1126/science.aaf7907. Epub May 26, 2016.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas. 0807883106. Epub Mar. 23, 2009.

McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Mead et al., A novel protective prion protein variant that colocalizes with kuru exposure. N Engl J Med. Nov. 19, 2009;361(21):2056-65. doi: 10.1056/NEJMoa0809716.

Meinke et al., Cre Recombinase and Other Tyrosine Recombinases. Chem Rev. Oct. 26, 2016;116(20):12785-12820. doi: 10.1021/acs. chemrev.6b00077. Epub May 10, 2016.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.

Mertens et al., Site-specific recombination in bacteriophage Mu: characterization of binding sites for the DNA invertase Gin. EMBO J. Apr. 1988;7(4):1219-27.

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.

Meyer et al., Library generation by gene shuffling. Curr Protoc Mol Biol. Jan. 6, 2014;105:Unit 15.12.. doi: 10.1002/0471142727. mb1512s105.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Michel et al., Mitochondrial class II introns encode proteins related to the reverse transcriptases of retroviruses. Nature. Aug. 15-21, 1985;316(6029):641-3. doi: 10.1038/316641a0.

Mihai et al., PTEN inhibition improves wound healing in lung epithelia through changes in cellular mechanics that enhance migration. Am J Physiol Lung Cell Mol Physiol. 2012;302(3):L287-L299.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., Construction and properties of retrovirus packaging cells based on gibbon ape leukemia virus. J Virol. May 1991;65(5):2220-4. doi: 10.1128/JVI.65.5.2220-2224.1991.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller, Human gene therapy comes of age. Nature. Jun. 11, 1992;357(6378):455-60. doi: 10.1038/357455a0.

(56) References Cited

OTHER PUBLICATIONS

Mills et al., Protein splicing in trans by purified N- and C-terminal fragments of the *Mycobacterium tuberculosis* RecA intein. Proc Natl Acad Sci U S A. Mar. 31, 1998;95(7):3543-8. doi: 10.1073/pnas.95.7.3543.
Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.
Mitani et al., Delivering therapeutic genes—matching approach and application. Trends Biotechnol. May 1993;11(5):162-6. doi: 10.1016/0167-7799(93)90108-L.
Mitton-Fry et al., Poly(A) tail recognition by a viral RNA element through assembly of a triple helix. Science. Nov. 26, 2010;330(6008):1244-7. doi: 10.1126/science.1195858.
Miyaoka et al., Systematic quantification of HDR and NHEJ reveals effects of locus, nuclease, and cell type on genome-editing. Sci Rep. Mar. 31, 2016;6:23549. doi: 10.1038/srep23549.
Moede et al., Identification of a nuclear localization signal, RRMKWKK, in the homeodomain transcription factor PDX-1. Febs Lett. Nov. 19, 1999;461(3):229-34. doi: 10.1016/s0014-5793(99)01446-5.
Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018.
Mohr et al., Thermostable group II intron reverse transcriptase fusion proteins and their use in cDNA synthesis and next-generation RNA sequencing. RNA. Jul. 2013;19(7):958-70. doi: 10.1261/ma.039743.113. Epub May 22, 2013.
Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.
Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.
Morita et al., The site-specific recombination system of actinophage TG1. FEMS Microbiol Lett. Aug. 2009;297(2):234-40. doi: 10.1111/j.1574-6968.2009.01683.x.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa.36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Newby et al., Base editing of haematopoietic stem cells rescues sickle cell disease in mice. Nature. Jun. 2, 2021. doi: 10.1038/s41586-021-03609-w. Epub ahead of print.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-IREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.
Nowak et al., Structural analysis of monomeric retroviral reverse transcriptase in complex with an RNA/DNA hybrid. Nucleic Acids Res. Apr. 1, 2013 ;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Odsbu et al., Specific N-terminal interactions of the *Escherichia coli* SeqA protein are required to form multimers that restrain negative supercoils and form foci. Genes Cells. Nov. 2005; 10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from Streptomyces cyanogenus. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.

(56) References Cited

OTHER PUBLICATIONS

O'Maille et al., Structure-based combinatorial protein engineering (SCOPE). J Mol Biol. Aug. 23, 2002;321(4):677-91.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Otto et al., The probability of fixation in populations of changing size. Genetics. Jun. 1997;146(2):723-33.
Packer et al., Methods for the directed evolution of proteins. Nat Rev Genet. Jul. 2015;16(7):379-94. doi: 10.1038/nrg3927. Epub Jun. 9, 2015.
Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi: 10.1126/science.1207339.
Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Park et al., Digenome-seq web tool for profiling CRISPR specificity. Nat Methods. May 30, 2017;14(6):548-549. doi: 10.1038/nmeth.4262.
Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pawson et al., Protein phosphorylation in signaling—50 years and counting. Trends Biochem Sci. Jun. 2005;30(6):286-90. doi: 10.1016/j.tibs.2005.04.013.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Petersen-Mahrt et al., AID mutates *E. coli* suggesting a DNA deamination mechanism for antibody diversification. Nature. Jul. 4, 2002;418(6893):99-103.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Popp et al., Sortagging: a versatile method for protein labeling. Nat Chem Biol. Nov. 2007;3(11):707-8. doi: 10.1038/nchembio.2007.31. Epub Sep. 23, 2007.
Posnick et al., Imbalanced base excision repair increases spontaneous mutation and alkylation sensitivity in *Escherichia coli*. J Bacteriol. Nov. 1999;181(21):6763-71.
Pruschy et al., Mechanistic studies of a signaling pathway activated by the organic dimerizer FK1012. Chem Biol. Nov. 1994;1(3):163-72. doi: 10.1016/1074-5521(94)90006-x.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.
Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Ramamurthy et al., Identification of immunogenic B-cell epitope peptides of rubella virus E1 glycoprotein towards development of highly specific immunoassays and/or vaccine. Conference Abstract. 2019.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.
Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Rasila et al., Critical evaluation of random mutagenesis by error-prone polymerase chain reaction protocols, *Escherichia coli* muta-

(56) References Cited

OTHER PUBLICATIONS tor strain, and hydroxylamine treatment. Anal Biochem. May 1, 2009;388(1):71-80. doi: 10.1016/j.ab.2009.02.008. Epub Feb. 10, 2009.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 RNA polymerase mutants with altered promoter specificities. Proc Natl Acad Sci U S A. Apr. 15, 1993;90(8):3147-51.
Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.
Ray et al., A compendium of RNA-binding motifs for decoding gene regulation. Nature. Jul. 11, 2013;499(7457):172-7. doi: 10.1038/nature12311.
Rebar et al., Phage display methods for selecting zinc finger proteins with novel DNA-binding specificities. Methods Enzymol. 1996;267:129-49.
Rees et al., Analysis and minimization of cellular RNA editing by DNA adenine base editors. Sci Adv. May 8, 2019;5(5):eaax5717. doi: 10.1126/sciadv.aax5717.
Rees et al., Base editing: precision chemistry on the genome and transcriptome of living cells. Nat Rev Genet. Dec. 2018;19(12):770-788. doi: 10.1038/s41576-018-0059-1.
Rees et al., Development of hRad51-Cas9 nickase fusions that mediate HDR without double-stranded breaks. Nat Commun. May 17, 2019;10(1):2212. doi: 10.1038/s41467-019-09983-4.
Remy et al., Gene transfer with a series of lipophilic DNA-binding molecules. Bioconjug Chem. Nov.-Dec. 1994;5(6):647-54. doi: 10.1021/bc00030a021.
Ribeiro et al., Protein Engineering Strategies to Expand CRISPR-Cas9 Applications. Int J Genomics. Aug. 2, 2018;2018:1652567. doi: 10.1155/2018/1652567.
Richter et al.,. Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Ringrose et al., The Kw recombinase, an integrase from Kluyveromyces waltii. Eur J Biochem. Sep. 15, 1997;248(3):903-12. doi: 10.1111/j.1432-1033.1997.00903.x.
Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robinson et al., The protein tyrosine kinase family of the human genome. Oncogene. Nov. 20, 2000;19(49):5548-57. doi: 10.1038/sj.onc.1203957.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rüfer et al., Non-contact positions impose site selectivity on Cre recombinase. Nucleic Acids Res. Jul. 1, 2002;30(13):2764-71. doi: 10.1093/nar/gkf399.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Sadowski, The Flp recombinase of the 2-microns plasmid of *Saccharomyces cerevisiae*. Prog Nucleic Acid Res Mol Biol. 1995;51:53-91.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sarkar et al., HIV-1 pro viral DNA excision using an evolved recombinase. Science. Jun. 29, 2007;316(5833):1912-5. doi: 10.1126/science.1141453.
Satomura et al., Precise genome-wide base editing by the CRISPR Nickase system in yeast. Sci Rep. May 18, 2017;7(1):2095. doi: 10.1038/s41598-017-02013-7.
Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR-Display. Nat Methods. Jul. 2015;12(7):664-70.

(56) References Cited

OTHER PUBLICATIONS doi: 10.1038/nmeth.3433. Epub Jun. 1, 2015. Author manuscript entitled CRISPR Display: A modular method for locus-specific targeting of long noncoding RNAs and synthetic RNA devices in vivo.

Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.

Schenk et al., MPDU1 mutations underlie a novel human congenital disorder of glycosylation, designated type If. J Clin Invest. Dec. 2001;108(11):1687-95. doi: 10.1172/JCI13419.

Schmitz et al., Behavioral abnormalities in prion protein knockout mice and the potential relevance of PrP(C) for the cytoskeleton. Prion. 2014;8(6):381-6. doi: 10.4161/19336896.2014.983746.

Schöller et al., Interactions, localization, and phosphorylation of the m6A generating METTL3-METTL14-WTAP complex. RNA. Apr. 2018;24(4):499-512. doi: 10.1261/ma.064063.117. Epub Jan. 18, 2018.

Schultz et al., Expression and secretion in yeast of a 400-kDa envelope glycoprotein derived from Epstein-Barr virus. Gene. 1987;54(1):113-23. doi: 10.1016/0378-1119(87)90353-2.

Schultz et al., Oligo-2'-fluoro-2'-deoxynucleotide N3'→P5' phosphoramidates: synthesis and properties. Nucleic Acids Res. Aug. 1, 1996;24(15):2966-73.

Scott et al., Production of cyclic peptides and proteins in vivo. Proc Natl Acad Sci U S A. Nov. 23, 1999;96(24):13638-43. doi: 10.1073/pnas.96.24.13638.

Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.

Seed, An LFA-3 cDNA encodes a phospholipid-linked membrane protein homologous to its receptor CD2. Nature. Oct. 29-Nov. 4, 1987;329(6142):840-2. doi: 10.1038/329840a0.

Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.

Setten et al., The current state and future directions of RNAi-based therapeutics. Nat Rev Drug Discov. Jun. 2019;18(6):421-446. doi: 10.1038/s41573-019-0017-4.

Severinov et al., Expressed protein ligation, a novel method for studying protein-protein interactions in transcription. J Biol Chem. Jun. 26, 1998;273(26):16205-9. doi: 10.1074/jbc.273.26.16205.

Sha et al., Monobodies and other synthetic binding proteins for expanding protein science. Protein Sci. May 2017;26(5):910-924. doi: 10.1002/pro.3148. Epub Mar. 24, 2017.

Shah et al., Protospacer recognition motifs: mixed identities and functional diversity. RNA Biol. May 2013;10(5):891-9. doi: 10.4161/rna.23764. Epub Feb. 12, 2013.

Shalem et al., High-throughput functional genomics using CRISPR-Cas9. Nat Rev Genet. May 2015;16(5):299-311. doi: 10.1038/nrg3899. Epub Apr. 9, 2015.

Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.

Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.

Shaw et al., Implications of human genome architecture for rearrangement-based disorders: the genomic basis of disease. Hum Mol Genet. Apr. 1, 2004 ;13 Spec No. 1:R57-64. doi: 10.1093/hmg/ddh073. Epub Feb. 5, 2004.

Shen et al., Predictable and precise template-free CRISPR editing of pathogenic variants. Nature. Nov. 2018;563(7733):646-651. doi: 10.1038/s41586-018-0686-x. Epub Nov. 7, 2018.

Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.

Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.

Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.

Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.

Shin et al., CRISPR/Cas9 targeting events cause complex deletions and insertions at 17 sites in the mouse genome. Nat Commun. May 31, 2017;8:15464. doi: 10.1038/ncomms15464.

Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.

Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.

Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.

Shultz et al., A genome-wide analysis of FRT-like sequences in the human genome. PLoS One. Mar. 23, 2011;6(3):e18077. doi: 10.1371/journal.pone.0018077.

Silas et al., Direct CRISPR spacer acquisition from RNA by a natural reverse transcriptase-Cas1 fusion protein. Science. Feb. 26, 2016;351(6276):aad4234. doi: 10.1126/science.aad4234.

Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.

Singh et al., Cross-talk between diverse serine integrases. J Mol Biol. Jan. 23, 2014;426(2):318-31. doi: 10.1016/j.jmb.2013.10.013. Epub Oct. 22, 2013.

Singh et al., Real-time observation of DNA recognition and rejection by the RNA-guided endonuclease Cas9. Nat Commun. Sep. 14, 2016;7:12778. doi: 10.1038/ncomms12778.

Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.

Sledz et al., Structural insights into the molecular mechanism of the m(6)A writer complex. Elife. Sep. 14, 2016;5:e18434. doi: 10.7554/eLife.18434.

Smargon et al., Cas 13b Is a Type VI.B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.

Smith et al., Production of human beta interferon in insect cells infected with a baculovirus expression vector. Mol Cell Biol. Dec. 1983;3(12):2156-65. doi: 10.1128/mcb.3.12.2156.

Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.

Smith, Phage-encoded Serine Integrases and Other Large Serine Recombinases. Microbiol Spectr. Aug. 2015;3(4). doi: 10.1128/microbiolspec.MDNA3-0059-2014.

Sommerfelt et al., Receptor interference groups of 20 retroviruses plating on human cells. Virology. May 1990;176(1):58-69. doi: 10.1016/0042-6822(90)90230-o.

Southworth et al., Control of protein splicing by intein fragment reassembly. EMBO J. Feb. 16, 1998;17(4):918-26. doi: 10.1093/emboj/17.4.918.

Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.

(56) References Cited

OTHER PUBLICATIONS

Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stadtman, Selenocysteine. Annu Rev Biochem. 1996;65:83-100.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Steele et al., The prion protein knockout mouse: a phenotype under challenge. Prion. Apr.-Jun. 2007;1(2):83-93. doi: 10.4161/pri.1.2.4346. Epub Apr. 25, 2007.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Sterne-Weiler et al., Exon identity crisis: disease-causing mutations that disrupt the splicing code. Genome Biol. Jan. 23, 2014;15(1):201. doi: 10.1186/gb4150.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Thomson et al., Mutational analysis of loxP sites for efficient Cre-mediated insertion into genomic DNA. Genesis. Jul. 2003;36(3):162-7. doi: 10.1002/gene.10211.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.

(56) References Cited

OTHER PUBLICATIONS

Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011; 145(2):198-211. doi: 10.1016/j.cell.2011.03.004.
Tycko et al., Pairwise library screen systematically interrogates *Staphylococcus aureus* Cas9 specificity in human cells. bioRxiv. doi: https://doi.org/10.1101/269399 Posted Feb. 22, 2018.
UniProt Consortium, UniProt: the universal protein knowledgebase. Nucleic Acids Res. Mar. 16, 2018;46(5):2699. doi: 10.1093/nar/gky092.
UniProtein A0A1V6. Dec. 11, 2019.
UNIPROTKB Submission; Accession No. F0NH53. May 3, 2011. 4 pages.
UNIPROTKB Submission; Accession No. F0NN87. May 3, 2011. 4 pages.
UNIPROTKB Submission; Accession No. T0D7A2. Oct. 16, 2013. 10 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (NY). 1988;6(10):1149-1154. doi: 10.1038/nbt1088-1149.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Voigt et al., Rational evolutionary design: the theory of in vitro protein evolution. Adv Protein Chem. 2000;55:79-160.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Highly efficient CRISPR/HDR-mediated knock-in for mouse embryonic stem cells and zygotes. Biotechniques. 2015:59,201-2;204;206-8.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.

(56) References Cited

OTHER PUBLICATIONS

West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.

Wharton et al., A new-specificity mutant of 434 repressor that defines an amino acid-base pair contact. Nature. Apr. 30-May 6, 1987;326(6116):888-91.

Wharton et al., Changing the binding specificity of a repressor by redesigning an alpha-helix. Nature. Aug. 15-21, 1985;316(6029):601-5.

Wheeler et al., The thermostability and specificity of ancient proteins. Curr Opin Struct Biol. Jun. 2016;38:37-43. doi: 10.1016/j.sbi.2016.05.015. Epub Jun. 9, 2016.

Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.

Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.

Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.

Wilson et al., Kinase dynamics. Using ancient protein kinases to unravel a modern cancer drug's mechanism. Science. Feb. 20, 2015;347(6224):882-6. doi: 10.1126/science.aaa1823.

Wilson et al., Programmable m6A modification of cellular RNAs with a Cas 13-directed methyltransferase. Nat Biotechnol. Dec. 2020;38(12):1431-1440. doi: 10.1038/s41587-020-0572-6. Epub Jun. 29, 2020.

Winoto et al., A novel, inducible and T cell-specific enhancer located at the 3' end of the T cell receptor alpha locus. EMBO J. Mar. 1989;8(3):729-33.

Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.

Winter et al., Targeted exon skipping with AAV-mediated split adenine base editors. Cell Discov. Aug. 20, 2019;5:41. doi: 10.1038/s41421-019-0109-7.

Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.

Wong et al., A statistical analysis of random mutagenesis methods used for directed protein evolution. J Mol Biol. Jan. 27, 2006;355(4):858-71. Epub Nov. 17, 2005.

Wong et al., The Diversity Challenge in Directed Protein Evolution. Comb Chem High Throughput Screen. May 2006;9(4):271-88.

Wood et al., A genetic system yields self-cleaving inteins for bioseparations. Nat Biotechnol. Sep. 1999;17(9):889-92. doi: 10.1038/12879.

Wright et al., Continuous in vitro evolution of catalytic function. Science. Apr. 25, 1997;276(5312):614-7.

Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.

Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.

Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.

Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.

Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.

Xiang et al., RNA m6A methylation regulates the ultraviolet-induced DNA damage response. Nature. Mar. 23, 2017;543(7646):573-576. doi: 10.1038/nature21671. Epub Mar. 15, 2017.

Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.

Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.

Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.

Xiong et al., Origin and evolution of retroelements based upon their reverse transcriptase sequences. EMBO J. Oct. 1990;9(10):3353-62.

Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.

Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.

Xu et al., Protein splicing: an analysis of the branched intermediate and its resolution by succinimide formation. EMBO J. Dec. 1, 1994;13(23):5517-22.

Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.

Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.

Xu et al., The mechanism of protein splicing and its modulation by mutation. EMBO J. Oct. 1, 1996;15(19):5146-53.

Yamamoto et al., The ons and offs of inducible transgenic technology: a review. Neurobiol Dis. Dec. 2001;8(6):923-32.

Yamazaki et al., Segmental Isotope Labeling for Protein NMR Using Peptide Splicing. J. Am. Chem. Soc. May 22, 1998; 120(22):5591-2. https://doi.org/10.1021/ja980776o.

Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.

Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.

Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.

Yang et al., Permanent genetic memory with >1-byte capacity. Nat Methods. Dec. 2014;11(12):1261-6. doi: 10.1038/nmeth.3147. Epub Oct. 26, 2014.

Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

(56) References Cited

OTHER PUBLICATIONS

Yang, Nucleases: diversity of structure, function and mechanism. Q Rev Biophys. Feb. 2011;44(1):1-93. doi: 10.1017/S0033583510000181. Epub Sep. 21, 2010.

Yang, PAML 4: phylogenetic analysis by maximum likelihood. Mol Biol Evol. Aug. 2007;24(8):1586-91. doi: 10.1093/molbev/msm088. Epub May 4, 2007.

Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.

Yeh et al., In vivo base editing of post-mitotic sensory cells. Nat Commun. Jun. 5, 2018;9(1):2184. doi: 10.1038/s41467-018-04580-3.

Yokoe et al., Spatial dynamics of GFP-tagged proteins investigated by local fluorescence enhancement. Nat Biotechnol. Oct. 1996;14(10):1252-6. doi: 10.1038/nbt1096-1252.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.

Yu et al., Progress towards gene therapy for HIV infection. Gene Ther. Jan. 1994;1(1):13-26.

Yu et al., Small molecules enhance CRISPR genome editing in pluripotent stem cells. Cell Stem Cell. Feb. 5, 2015;16(2):142-7. doi: 10.1016/j.stem.2015.01.003.

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.

Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.

Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.

Zhang et al., A new strategy for the site-specific modification of proteins in vivo. Biochemistry. Jun. 10, 2003;42(22):6735-46.

Zhang et al., Circular intronic long noncoding RNAs. Mol Cell. Sep. 26, 2013;51(6):792-806. doi: 10.1016/j.molcel.2013.08.017. Epub Sep. 12, 2013.

Zhang et al., Copy number variation in human health, disease, and evolution. Annu Rev Genomics Hum Genet. 2009;10:451-81. doi: 10.1146/annurev.genom.9.081307.164217.

Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.

Zhang et al., π-Clamp-mediated cysteine conjugation. Nat Chem. Feb. 2016;8(2):120-8. doi: 10.1038/nchem.2413. Epub Dec. 21, 2015.

Zhao et al., An ultraprocessive, accurate reverse transcriptase encoded by a metazoan group II intron. RNA. Feb. 2018;24(2):183-195. doi: 10.1261/ma.063479.117. Epub Nov. 6, 2017.

Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.

Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

Zheng et al., Highly efficient base editing in bacteria using a Cas9-cytidine deaminase fusion. Commun Biol. Apr. 19, 2018;1:32. doi: 10.1038/s42003-018-0035-5.

Zheng et al., Structural basis for the complete resistance of the human prion protein mutant G127V to prion disease. Sci Rep. Sep. 4, 2018;8(1):13211. doi: 10.1038/s41598-018-31394-6.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.

Zielenski, Genotype and phenotype in cystic fibrosis. Respiration. 2000;67(2):117-33. doi: 10.1159/000029497.

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

\* cited by examiner

| EMX1 | | $C_5$ | $C_6$ | $C_{10}$ |
|---|---|---|---|---|
| 0 uM XTEN | A | 0.1% | 0.1% | 0.1% |
| | C | 99.8% | 99.8% | 99.8% |
| | G | 0.0% | 0.0% | 0.1% |
| | T | 0.0% | 0.1% | 0.0% |
| 1.85 uM XTEN | A | 0.1% | 0.0% | 0.1% |
| | C | 60.4% | 61.0% | 99.1% |
| | G | 0.0% | 0.0% | 0.1% |
| | T | 39.5% | 39.0% | 0.7% |

| FANCF | | $C_6$ | $C_7$ | $C_8$ | $C_{11}$ |
|---|---|---|---|---|---|
| 0 uM XTEN | A | 0.1% | 0.1% | 0.1% | 0.1% |
| | C | 99.8% | 99.8% | 99.9% | 99.9% |
| | G | 0.0% | 0.1% | 0.0% | 0.0% |
| | T | 0.0% | 0.0% | 0.0% | 0.0% |
| 1.85 uM XTEN | A | 0.1% | 0.1% | 0.1% | 0.1% |
| | C | 63.9% | 64.7% | 65.0% | 72.6% |
| | G | 0.0% | 0.0% | 0.0% | 0.0% |
| | T | 36.0% | 35.1% | 34.9% | 27.3% |

| HEK293 site 2 | | $C_4$ | $C_6$ | $C_{11}$ |
|---|---|---|---|---|
| 0 uM XTEN | A | 0.1% | 0.1% | 0.1% |
| | C | 99.9% | 99.9% | 99.9% |
| | G | 0.0% | 0.0% | 0.0% |
| | T | 0.0% | 0.0% | 0.1% |
| 1.85 uM XTEN | A | 0.1% | 0.1% | 0.1% |
| | C | 80.6% | 76.9% | 99.6% |
| | G | 0.0% | 0.0% | 0.0% |
| | T | 19.3% | 22.9% | 0.3% |

| HEK293 site 3 | | $C_3$ | $C_4$ | $C_5$ | $C_9$ |
|---|---|---|---|---|---|
| 0 uM XTEN | A | 0.1% | 0.1% | 0.0% | 0.1% |
| | C | 99.8% | 99.9% | 99.9% | 99.9% |
| | G | 0.0% | 0.0% | 0.0% | 0.0% |
| | T | 0.1% | 0.0% | 0.0% | 0.0% |
| 1.85 uM XTEN | A | 0.1% | 0.1% | 0.0% | 0.1% |
| | C | 92.2% | 74.8% | 71.5% | 96.6% |
| | G | 0.0% | 0.0% | 0.0% | 0.0% |
| | T | 7.7% | 25.1% | 28.5% | 3.3% |

| HEK293 site 4 | | $C_3$ | $C_5$ | $C_8$ | $C_{11}$ |
|---|---|---|---|---|---|
| 0 uM XTEN | A | 0.1% | 0.0% | 0.1% | 0.0% |
| | C | 99.8% | 99.9% | 99.8% | 99.9% |
| | G | 0.0% | 0.0% | 0.0% | 0.0% |
| | T | 0.0% | 0.0% | 0.1% | 0.0% |
| 1.85 uM XTEN | A | 0.1% | 0.1% | 0.1% | 0.1% |
| | C | 98.8% | 60.1% | 97.0% | 99.4% |
| | G | 0.0% | 0.0% | 0.0% | 0.0% |
| | T | 1.1% | 39.8% | 2.9% | 0.5% |

| RNF2 | | $C_3$ | $C_6$ |
|---|---|---|---|
| 0 uM XTEN | A | 0.1% | 0.0% |
| | C | 99.9% | 99.9% |
| | G | 0.0% | 0.0% |
| | T | 0.0% | 0.0% |
| 1.85 uM XTEN | A | 0.1% | 0.0% |
| | C | 59.1% | 57.8% |
| | G | 0.0% | 0.0% |
| | T | 40.8% | 42.1% |

FIG. 9

| EMX1 | | $C_5$ | $C_6$ | $C_{10}$ |
|---|---|---|---|---|
| untreated | A | 0.0% | 0.0% | 0.0% |
| | C | 99.5% | 99.7% | 100.0% |
| | G | 0.0% | 0.1% | 0.0% |
| | T | 0.5% | 0.2% | 0.0% |
| XTEN | A | 0.7% | 0.5% | 0.0% |
| | C | 93.5% | 95.8% | 100.0% |
| | G | 2.1% | 0.3% | 0.0% |
| | T | 3.6% | 3.3% | 0.0% |
| XTEN-UGI | A | 0.2% | 0.0% | 0.0% |
| | C | 81.8% | 82.5% | 100.0% |
| | G | 0.6% | 0.3% | 0.0% |
| | T | 17.4% | 17.1% | 0.0% |

| FANCF | | $C_6$ | $C_7$ | $C_8$ | $C_{11}$ |
|---|---|---|---|---|---|
| untreated | A | 0.0% | 0.0% | 0.2% | 0.1% |
| | C | 99.9% | 99.8% | 99.8% | 99.9% |
| | G | 0.0% | 0.0% | 0.0% | 0.0% |
| | T | 0.1% | 0.1% | 0.0% | 0.0% |
| XTEN | A | 0.3% | 0.1% | 0.0% | 0.0% |
| | C | 98.1% | 99.2% | 99.0% | 99.8% |
| | G | 0.4% | 0.0% | 0.0% | 0.0% |
| | T | 1.2% | 0.7% | 1.0% | 0.2% |
| XTEN-UGI | A | 0.0% | 0.0% | 0.1% | 0.0% |
| | C | 93.2% | 93.5% | 93.4% | 98.2% |
| | G | 0.0% | 0.0% | 0.0% | 0.0% |
| | T | 6.7% | 6.5% | 6.5% | 1.8% |

| HEK293 site 2 | | $C_4$ | $C_6$ | $C_{11}$ |
|---|---|---|---|---|
| untreated | A | 0.3% | 0.2% | 0.2% |
| | C | 99.7% | 99.7% | 99.7% |
| | G | 0.0% | 0.0% | 0.0% |
| | T | 0.0% | 0.0% | 0.0% |
| XTEN | A | 0.3% | 0.3% | 0.3% |
| | C | 99.7% | 99.4% | 99.7% |
| | G | 0.0% | 0.3% | 0.0% |
| | T | 0.0% | 0.0% | 0.0% |
| XTEN-UGI | A | 0.3% | 0.2% | 0.2% |
| | C | 98.8% | 98.2% | 99.8% |
| | G | 0.0% | 0.3% | 0.0% |
| | T | 0.9% | 1.3% | 0.0% |

| HEK293 site 2 | | $C_3$ | $C_4$ | $C_5$ | $C_9$ |
|---|---|---|---|---|---|
| untreated | A | 0.0% | 0.0% | 0.0% | 0.0% |
| | C | 100.0% | 100.0% | 100.0% | 99.9% |
| | G | 0.0% | 0.0% | 0.0% | 0.0% |
| | T | 0.0% | 0.0% | 0.0% | 0.1% |
| XTEN | A | 0.0% | 0.6% | 0.3% | 0.1% |
| | C | 100.0% | 95.8% | 95.8% | 99.2% |
| | G | 0.0% | 0.2% | 0.7% | 0.4% |
| | T | 0.0% | 3.4% | 3.2% | 0.3% |
| XTEN-UGI | A | 0.0% | 0.3% | 0.3% | 0.0% |
| | C | 96.8% | 83.0% | 79.2% | 98.5% |
| | G | 0.0% | 0.0% | 1.1% | 0.2% |
| | T | 3.2% | 16.8% | 19.4% | 1.3% |

| HEK293 site 4 | | $C_3$ | $C_5$ | $C_8$ | $C_{11}$ |
|---|---|---|---|---|---|
| untreated | A | 0.0% | 0.4% | 0.0% | 0.0% |
| | C | 99.8% | 97.6% | 99.9% | 100.0% |
| | G | 0.0% | 1.0% | 0.0% | 0.0% |
| | T | 0.2% | 1.0% | 0.0% | 0.0% |
| XTEN | A | 0.0% | 1.1% | 0.0% | 0.0% |
| | C | 99.6% | 92.2% | 99.9% | 100.0% |
| | G | 0.0% | 2.2% | 0.0% | 0.0% |
| | T | 0.4% | 4.5% | 0.0% | 0.0% |
| XTEN-UGI | A | 0.0% | 0.5% | 0.0% | 0.0% |
| | C | 99.4% | 86.7% | 99.1% | 100.0% |
| | G | 0.0% | 1.8% | 0.0% | 0.0% |
| | T | 0.6% | 11.0% | 0.9% | 0.0% |

| RNF2 | | $C_3$ | $C_6$ |
|---|---|---|---|
| untreated | A | 0.0% | 0.0% |
| | C | 99.9% | 99.5% |
| | G | 0.0% | 0.2% |
| | T | 0.0% | 0.3% |
| XTEN | A | 0.0% | 0.0% |
| | C | 99.8% | 99.3% |
| | G | 0.0% | 0.2% |
| | T | 0.2% | 0.5% |
| XTEN-UGI | A | 0.0% | 0.0% |
| | C | 99.6% | 99.1% |
| | G | 0.0% | 0.4% |
| | T | 0.4% | 0.5% |

FIG. 10

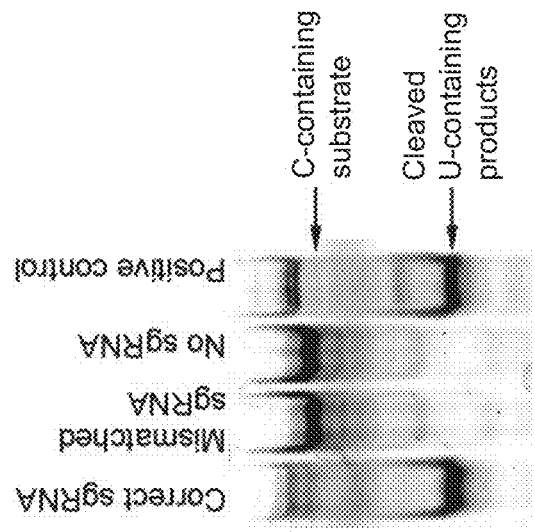
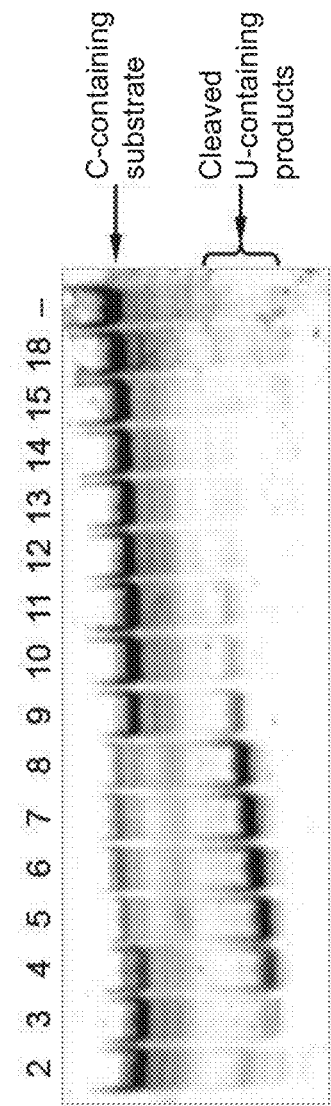
FIG. 11C
FIG. 11B

EMX1: GAGTC$_5$C$_6$GAGCAGAAGAAGAAGGG

FANCF: GGAATC$_6$C$_7$C$_8$TTC$_{11}$TGCAGCACCTGG

HEK293 site 2: GAAC$_4$AC$_6$AAAGCATAGACTGCGGG

HEK293 site 3: GGCC$_4$C$_5$AGACTGAGCACGTGATGG

HEK293 site 4: GGCAC$_5$TGCGGCTGGAGGTCCGGG

RNF2: GTC$_3$ATC$_6$TTAGTC$_{12}$ATTACCTGAGG

APOE4 Cys112Arg:    5'-GGAGGACGTGC$_{11}$GCGGCCGCCTGG
APOE4 Cys158Arg:    5'-GAAGC$_5$GCCTGGCAGTGTACCAGG
CTNNB1 Thr41Ala:    5'-CTGTGGC$_7$AGTGGCACCAGAATGG
HRAS Gln61Arg:      5'-CCTCCC$_6$GGCCGGCGGTATCCAGG
p53 Tyr163Cys:      5'-GCTTGC$_6$AGATGGCCATGGCGCGG
p53 Tyr236Cys:      5'-ACACATGC$_8$AGTTGTAGTGGATGG
p53 Asn239Asp:      5'-TGTC$_4$ACACATGTAGTTGTAGTGG

FIG. 16A

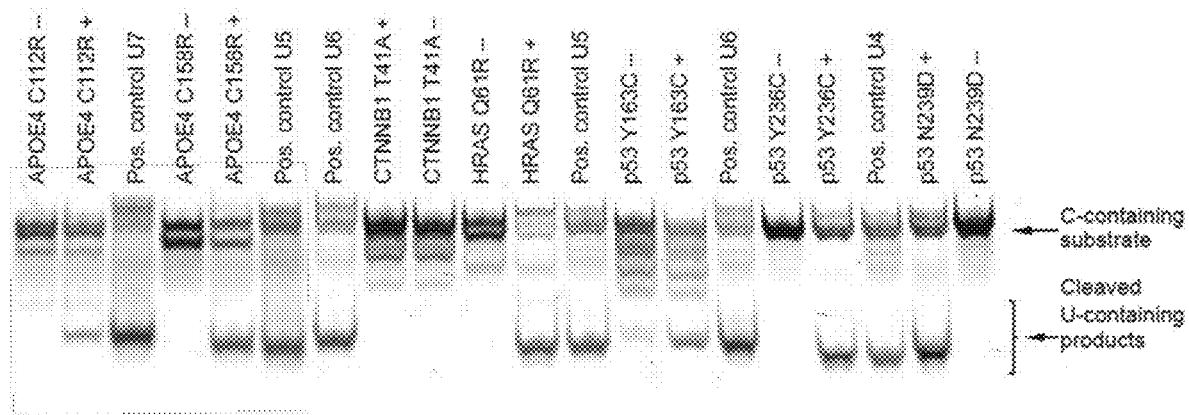

FIG. 16B

Protospacer and PAM sequence: 5'-TTCCCCCCCCGATTTATTTATGG-3'

| Sequence | % of total reads |
|---|---|
| CCCCCCCC | 62.4 |
| TTTTTTCC | 18.2 |
| TTTTTTTC | 13.4 |
| TTTTTTTT | 3.3 |
| TCCCCCCC | 0.8 |
| CCCCTTCC | 0.3 |
| CCCTTTCC | 0.3 |
| TTTTTCCC | 0.3 |
| CCCCTCCC | 0.3 |

FIG. 17

EMX1:        GAGTC$_5$C$_6$GAGCAGAAGAAGAAGGG
FANCF:       GGAATC$_6$C$_7$C$_8$TTC$_{11}$TGCAGCACCTGG
HEK293 site 2:   GAAC$_4$AC$_6$AAAGCATAGACTGCGGG
HEK293 site 3:   GGCC$_4$C$_5$AGACTGAGCACGTGATGG
HEK293 site 4:   GGCAC$_5$TGCGGCTGGAGGTCCGGG
RNF2:        GTC$_3$ATC$_6$TTAGTCATTACCTGAGG

FIG. 18A

| EMX1 | C$_5$ | C$_6$ |
|---|---|---|
| NBE1 | 6.2% | 6.5% |
| NBE1 + UGI | 9.7% | 10.1% |
| NBE2 | 8.0% | 8.7% |

FIG. 18B

| FANCF | C$_6$ | C$_7$ | C$_8$ | C$_{10}$ |
|---|---|---|---|---|
| NBE1 | 3.7% | 3.2% | 3.4% | 2.4% |
| NBE1 + UGI | 7.5% | 7.6% | 7.5% | 1.6% |
| NBE2 | 4.7% | 4.6% | 4.6% | 0.8% |

FIG. 18C

| HEK293 site 2 | C$_4$ | C$_6$ |
|---|---|---|
| NBE1 | 0.4% | 0.4% |
| NBE1 + UGI | 1.6% | 2.6% |
| NBE2 | 3.4% | 5.9% |

FIG. 18D

| HEK293 site 3 | $C_4$ | $C_6$ |
|---|---|---|
| NBE1 | 2.0% | 1.9% |
| NBE1 + UGI | 6.5% | 6.7% |
| NBE2 | 10.0% | 12.5% |

FIG. 18E

| HEK293 site 4 | $C_5$ |
|---|---|
| NBE1 | 1.4% |
| NBE1 + UGI | 5.4% |
| NBE2 | 8.2% |

FIG. 18F

| RNF2 | $C_3$ | $C_6$ |
|---|---|---|
| NBE1 | 0.7% | 1.4% |
| NBE1 + UGI | 3.4% | 3.9% |
| NBE2 | 2.5% | 3.7% |

FIG. 18G

| Non-protospacer Cs | C | T |
|---|---|---|
| untreated | 99.93% | 0.03% |
| NBE1 | 99.95% | 0.03% |
| NBE1 + UGI | 99.91% | 0.06% |
| NBE2 | 99.92% | 0.04% |

| Non-protospacer Cs | C (%) | T (%) |
|---|---|---|
| untreated | 99.94 | 0.04 |
| NBE1 | 99.92 | 0.05 |
| NBE2 | 99.92 | 0.05 |
| NBE3 | 99.94 | 0.03 |

HEK site 2 ChIP-seq off target 2 (28)

| | G | A | A | T | C | G | G | G | A | G | A | C | T | G | C | G | G |
|---|---|---|---|---|---|---|---|---|---|---|---|---|---|---|---|---|---|
| untreated | | | | | | | | | | | | | | | | | |
| BE1 | | | | 0.0 | 0.0 | | | | | | 0.0 | 0.0 | 0.0 | 0.0 | 0.0 | | |
| BE2 | | | | 0.0 | 0.0 | | | | | | 0.0 | 0.0 | 0.0 | 0.0 | 0.1 | | |
| BE3 | | | | 0.0 | 0.0 | | | | | | 0.0 | 0.0 | 0.0 | 0.0 | 0.1 | | |

HEK site 2 ChIP-seq off target 3 (23)

| | T | G | A | A | G | T | T | G | C | A | T | A | G | A | C | A | G |
|---|---|---|---|---|---|---|---|---|---|---|---|---|---|---|---|---|---|
| untreated | | | | | | | | | | | | | | | | | |
| BE1 | | 0.0 | | | | | | | 0.0 | | | | | | 0.0 | | |
| BE2 | | 0.0 | | | | | | | 0.0 | | | | | | 0.1 | | |
| BE3 | | 0.0 | | | | | | | 0.0 | | | | | | 0.0 | | |

HEK site 2 ChIP-seq off target 4 (16)

| | G | C | A | A | G | A | G | A | T | A | C | A | C | T | G | T | G |
|---|---|---|---|---|---|---|---|---|---|---|---|---|---|---|---|---|---|
| untreated | | | | | | | | | | | | | | | | | |
| BE1 | | | 0.0 | | | | | | | | 0.0 | | | 0.0 | | | |
| BE2 | | | 0.0 | | | | | | | | 0.0 | | | 0.0 | | | |
| BE3 | | | 0.0 | | | | | | | | 0.0 | | | 0.0 | | | |

HEK site 2 ChIP-seq off target 5 (10)

| | C | C | A | A | A | A | A | C | A | T | A | A | C | T | G | T | G |
|---|---|---|---|---|---|---|---|---|---|---|---|---|---|---|---|---|---|
| untreated | | | | | | | | | | | | | | | | | |
| BE1 | 0.0 | 0.0 | | | | | | 0.0 | | | | | 0.0 | 0.0 | 0.0 | | |
| BE2 | 0.0 | 0.0 | | | | | | 0.0 | | | | | 0.0 | 0.0 | 0.0 | | |
| BE3 | 0.0 | 0.0 | | | | | | 0.0 | | | | | 0.0 | 0.0 | 0.2 | | |

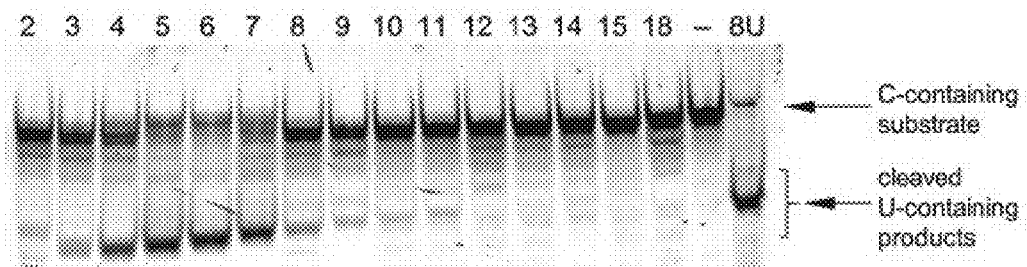
FIG. 36D
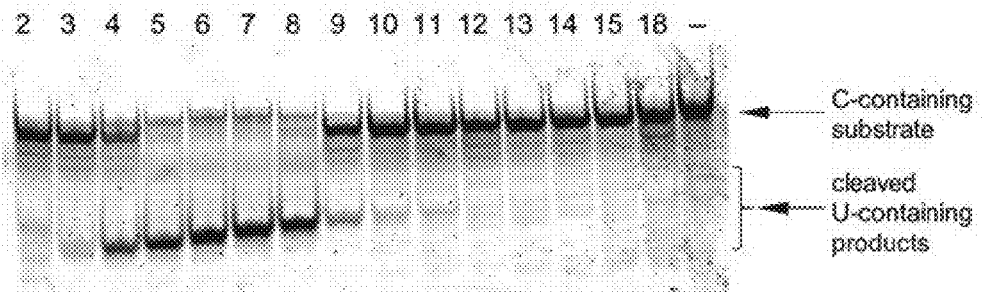
FIG. 36E
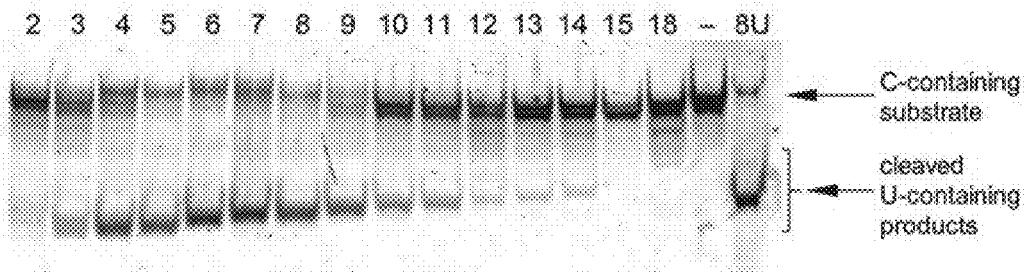
FIG. 36F
EMX1:           GAGTC$_5$C$_6$GAGCAGAAGAAGAA<u>GGG</u>
FANCF:          GGAATC$_6$C$_7$C$_8$TTC$_{11}$TGCAGCACC<u>TGG</u>
HEK293 site 2:  GAAC$_4$AC$_6$AAAGCATAGACTGC<u>GGG</u>
HEK293 site 3:  GGCC$_4$C$_5$AGACTGAGCACGTGA<u>TGG</u>
HEK293 site 4:  GGCAC$_5$TGCGGCTGGAGGTCC<u>GGG</u>
RNF2:           GTC$_3$ATC$_6$TTAGTC$_{12}$ATTACCTG<u>AGG</u>
FIG. 37A

FIG. 37B

| non-protospacer C/Gs | average C/G (%) | average T/A (%) | lowest T/A (%) | highest T/A (%) |
|---|---|---|---|---|
| untreated | 99.95 ± 0.14 | 0.02 ± 0.02 | 0.00 | 2.44 |
| BE1 | 99.95 ± 0.24 | 0.03 ± 0.03 | 0.00 | 1.64 |
| BE2 | 99.95 ± 0.13 | 0.03 ± 0.03 | 0.00 | 1.92 |
| BE3 | 99.97 ± 0.09 | 0.02 ± 0.02 | 0.00 | 2.52 |

Utilizing a bacterial strain with lacZ encoded on the F plasmid
Critical glutamic acid residue is mutated. Reversion restores lacZ activity.

Strain used to develop selection assay
Constructs used: APOBEC1 and CDA

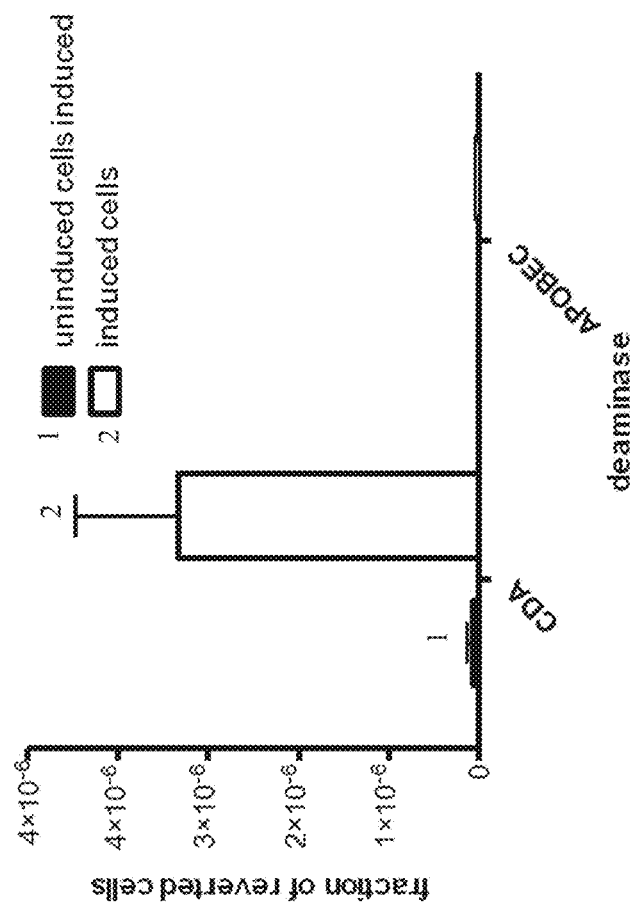
FIG. 49A
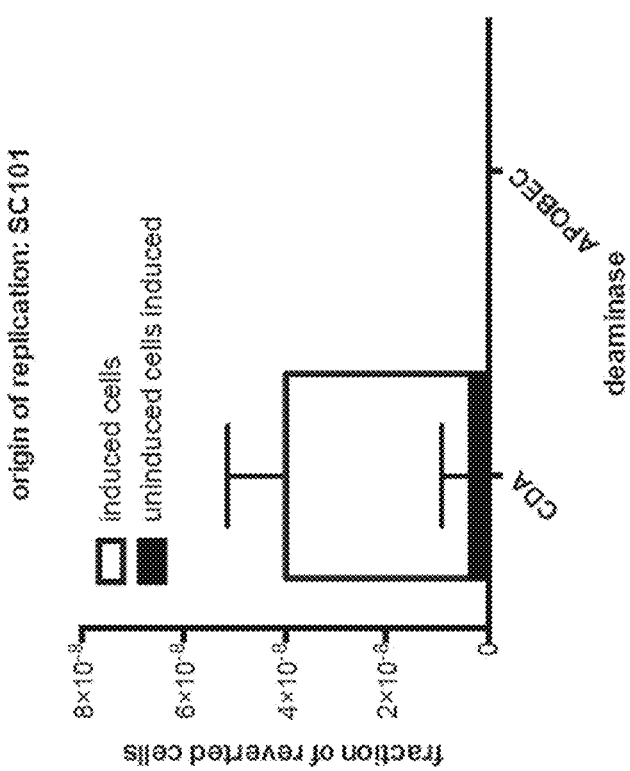

Row 1: CDA-dCas9 + selection plasmid (chlor$^S$)

Row 2: CDA-dCas9 + pos. control selection (chlor$^R$)

Row 3: rAPOBEC-dCas9 + selection plasmid (chlor$^S$)

Row 4: rAPOBEC-dCas9 + pos. control selection (chlor$^R$)

BE3
(SEQ ID NO: 776)

| Base | Lys | | | | Arg → Cys | | | | Leu → Leu | | | | Ala | | | | Tyr | | | | Gln | | | | (SEQ ID NO: 775) |
|---|---|---|---|---|---|---|---|---|---|---|---|---|---|---|---|---|---|---|---|---|---|---|---|---|---|
| | A | A | A | G | C | G | C | C | C | T | G | G | C | A | G | T | G | A | C | C |
| A | 99.9 | 99.8 | 0.0 | 0.0 | 1.0 | 0.1 | 1.8 | 1.2 | 0.0 | 0.0 | 0.1 | 0.1 | 99.8 | 0.0 | 0.1 | 0.0 | 0.1 | 99.9 | 0.1 | 0.0 |
| C | 0.0 | 0.1 | 0.0 | 0.0 | 38.1 | 0.0 | 49.8 | 52.3 | 0.0 | 0.0 | 0.0 | 99.7 | 0.1 | 0.0 | 0.1 | 0.0 | 0.0 | 0.0 | 99.9 | 99.9 |
| G | 99.8 | 0.0 | 99.9 | 0.1 | 1.8 | 99.8 | 1.3 | 0.7 | 99.9 | 99.9 | 99.8 | 0.0 | 0.1 | 99.9 | 0.1 | 0.0 | 99.9 | 0.0 | 0.0 | 0.0 |
| T | 0.0 | 0.1 | 0.1 | 99.8 | 59.2 | 0.1 | 47.0 | 45.8 | 0.1 | 0.1 | 0.1 | 0.2 | 0.0 | 0.1 | 99.8 | 99.8 | 0.0 | 0.1 | 0.1 | 0.1 |

BE3 W90Y R132E
(SEQ ID NO: 776)

| Base | Lys | | | | Arg → Cys | | | | Leu → Leu | | | | Ala | | | | Tyr | | | | Gln | | | | (SEQ ID NO: 775) |
|---|---|---|---|---|---|---|---|---|---|---|---|---|---|---|---|---|---|---|---|---|---|---|---|---|---|
| | A | A | A | G | C | G | C | C | C | T | G | G | C | A | G | T | G | A | C | C |
| A | 99.9 | 99.9 | 0.0 | 0.0 | 0.5 | 0.1 | 0.3 | 0.1 | 0.1 | 0.0 | 0.0 | 0.1 | 99.8 | 0.1 | 0.0 | 0.0 | 0.0 | 99.9 | 0.1 | 0.0 |
| C | 0.0 | 0.0 | 0.0 | 0.0 | 78.0 | 0.0 | 94.8 | 98.9 | 0.0 | 0.0 | 0.0 | 99.8 | 0.1 | 0.1 | 0.1 | 0.0 | 0.0 | 0.0 | 99.9 | 99.9 |
| G | 100.0 | 0.0 | 99.9 | 0.0 | 0.5 | 99.9 | 0.1 | 0.1 | 99.9 | 99.9 | 99.9 | 0.0 | 0.0 | 99.9 | 100.0 | 0.1 | 99.8 | 0.0 | 0.0 | 0.0 |
| T | 0.0 | 0.0 | 0.0 | 99.9 | 21.0 | 0.0 | 4.8 | 0.9 | 0.0 | 0.0 | 0.0 | 0.1 | 0.0 | 0.0 | 0.0 | 99.8 | 0.1 | 0.0 | 0.0 | 0.0 |

FIG. 72

| EMX1 off target 6 | G | A | G | T | C | C | G | G | G | A | G | G | A | A | G |
|---|---|---|---|---|---|---|---|---|---|---|---|---|---|---|---|
| untreated | | | | 0±0 | 0±0 | 0±0 | | | | | | | | | |
| BE3 | | | | 0±0 | 0.4±0 | 0.4±0 | | | | | | | | | |
| HF-BE3 | | | | 0±0 | 0±0 | 0±0 | | | | | | | | | |

| EMX1 off target 7 | G | A | G | C | C | C | G | A | C | A | G | A | A | G | G |
|---|---|---|---|---|---|---|---|---|---|---|---|---|---|---|---|
| untreated | | | | 0±0 | 0±0 | 0±0 | | | 0±0 | | | | | | |
| BE3 | | | | 0±0 | 0±0 | 0±0 | | | 0±0 | | | | | | |
| HF-BE3 | | | | 0±0 | 0±0 | 0±0 | | | 0±0 | | | | | | |

| EMX1 off target 8 | A | A | A | T | C | C | G | A | C | A | G | A | A | G | G |
|---|---|---|---|---|---|---|---|---|---|---|---|---|---|---|---|
| untreated | | | | 0±0 | 0±0 | 0±0 | | | 0±0 | | | | | | |
| BE3 | | | | 0±0 | 0±0 | 0±0 | | | 0±0 | | | | | | |
| HF-BE3 | | | | 0±0 | 0±0 | 0±0 | | | 0±0 | | | | | | |

| EMX1 off target 9 | G | A | A | T | C | C | A | A | C | A | G | A | A | G | A |
|---|---|---|---|---|---|---|---|---|---|---|---|---|---|---|---|
| untreated | | | | 0±0 | 0±0 | 0±0 | | | 0±0 | | | | | | |
| BE3 | | | | 0±0 | 0.1±0 | 0.1±0 | | | 0±0 | | | | | | |
| HF-BE3 | | | | 0±0 | 0±0 | 0±0 | | | 0±0 | | | | | | |

| EMX1 off target 10 | A | C | A | T | C | T | G | A | C | A | G | A | A | T | G |
|---|---|---|---|---|---|---|---|---|---|---|---|---|---|---|---|
| untreated | 0±0 | | | | 0±0 | 0±0 | | | 0±0 | | | | | | |
| BE3 | 0±0 | | | | 1.5±0.1 | 0±0 | | | 0±0 | | | | | | |
| HF-BE3 | 0±0 | | | | 1.1±0.2 | 0±0 | | | 0±0 | | | | | | | numbers are μ ± σ from three independent replicates

FIG. 76B

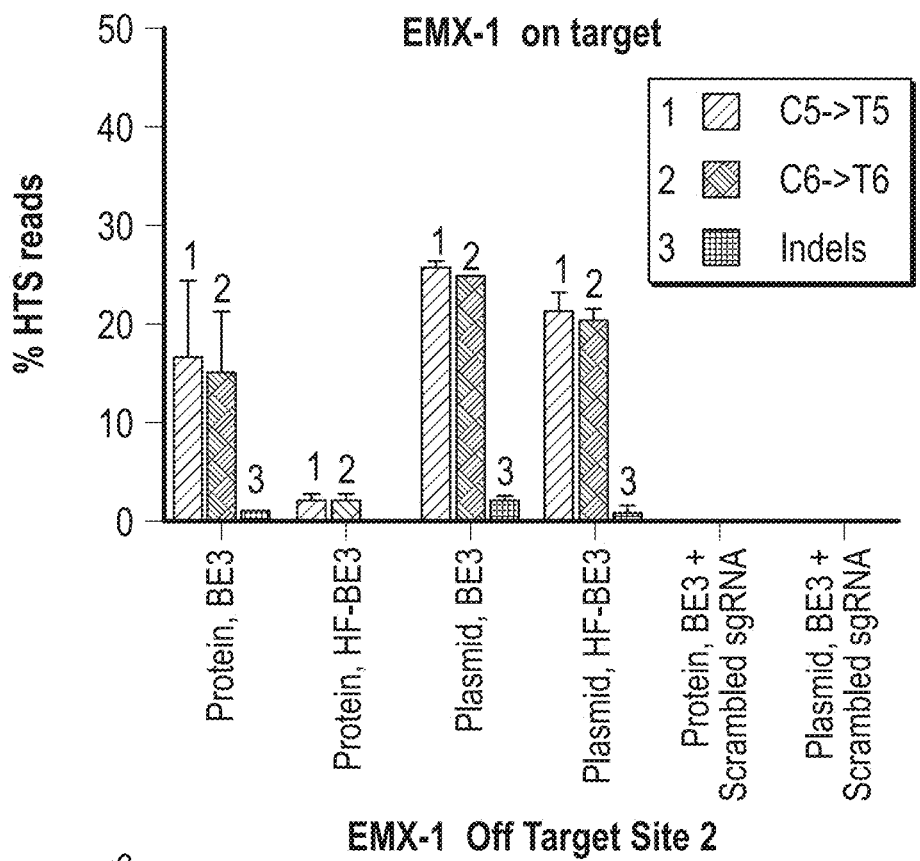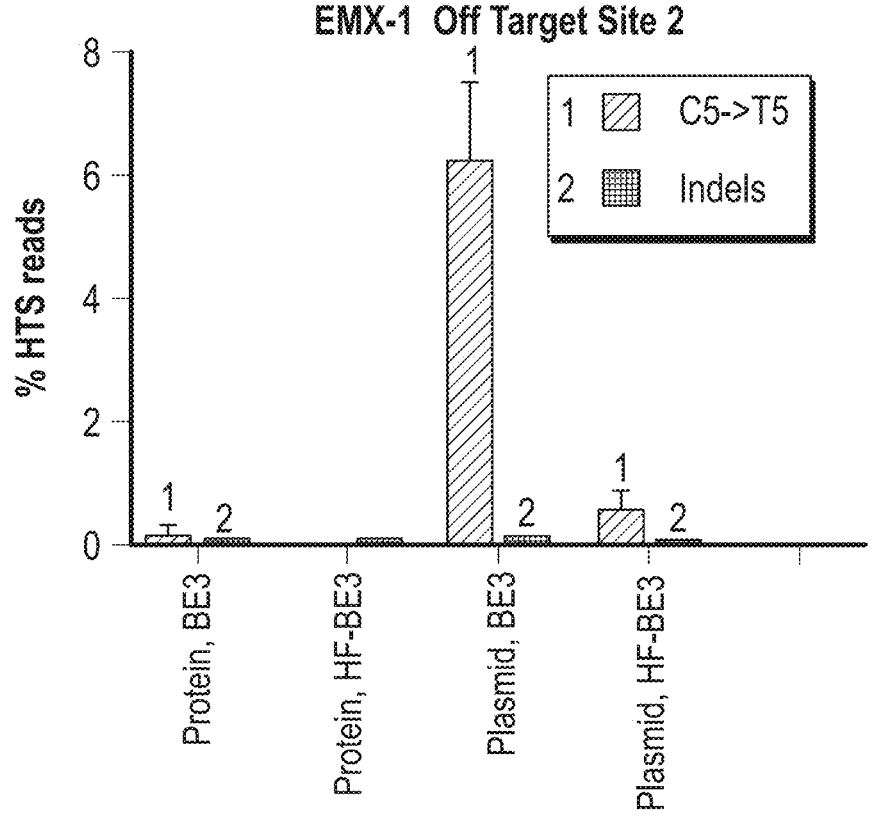
FIG. 77

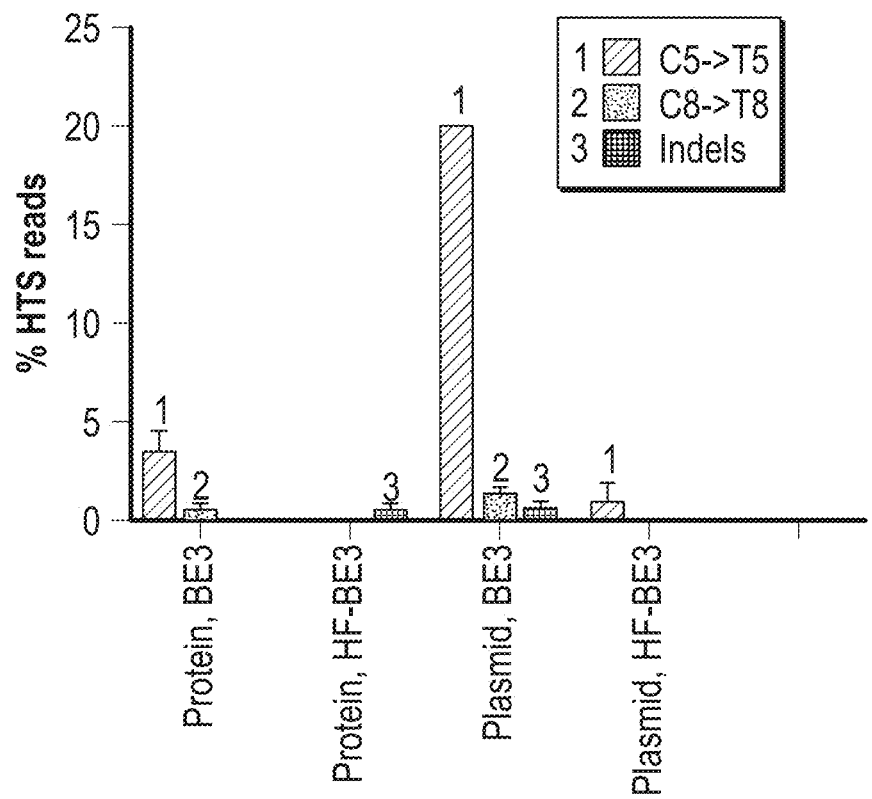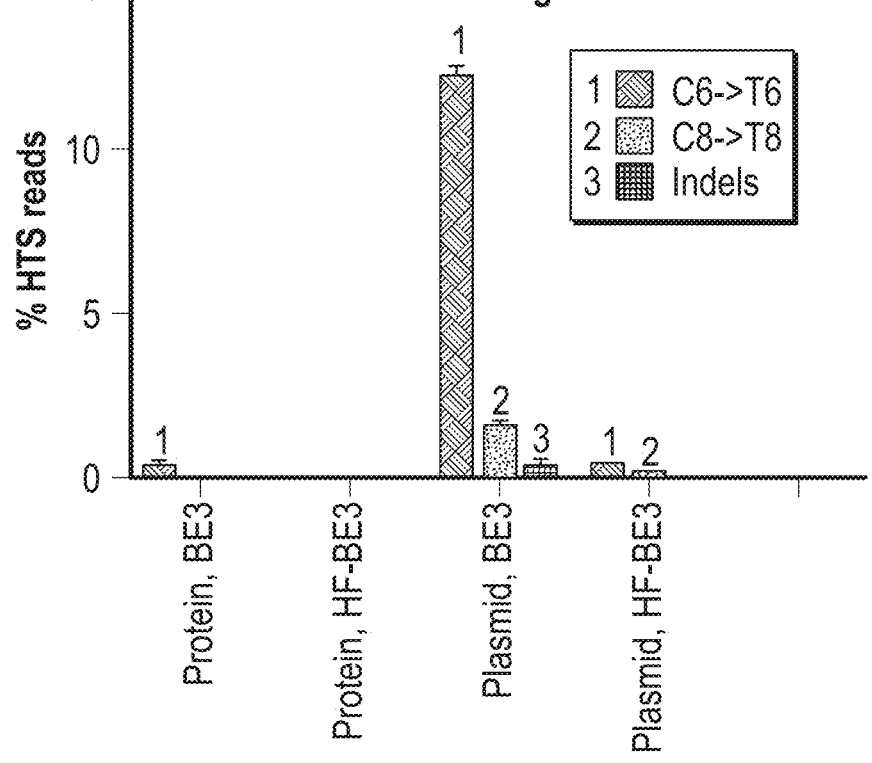
FIG. 80B

FIG. 88

| BE3-treated PRNP R37X | Gly | | Ser→Ser | | Arg 37→Stop | | | | Tyr | | | Pro | | | Gly | | | | Glu | | | |
|---|---|---|---|---|---|---|---|---|---|---|---|---|---|---|---|---|---|---|---|---|---|---|
| | G | G | C | A | G | C₇ | C₈ | G | A | T | A | C | C | C | G | G | G | G | C | A | G | G |
| A | 0.0 | 0.0 | 0.1 | 100.0 | 0.0 | 1.1 | 0.3 | 0.1 | 100.0 | 0.0 | 100.0 | 0.0 | 0.0 | 0.0 | 0.0 | 0.0 | 0.0 | 0.0 | 0.0 | 100.0 | 0.0 | 0.0 |
| C | 0.0 | 0.0 | 98.9 | 0.0 | 0.0 | 54.9 | 57.8 | 0.0 | 0.0 | 0.0 | 0.0 | 98.8 | 98.8 | 0.0 | 0.0 | 0.0 | 0.0 | 0.0 | 100.0 | 0.0 | 0.0 | 0.0 |
| G | 100.0 | 100.0 | 0.0 | 0.0 | 100.0 | 2.1 | 0.6 | 99.9 | 0.0 | 0.0 | 0.0 | 0.0 | 0.0 | 100.0 | 100.0 | 100.0 | 100.0 | 100.0 | 0.0 | 0.0 | 100.0 | 100.0 |
| T | 0.0 | 0.0 | 1.1 | 0.0 | 0.0 | 41.9 | 41.2 | 0.0 | 0.0 | 100.0 | 0.0 | 0.2 | 0.2 | 0.0 | 0.0 | 0.0 | 0.0 | 0.0 | 0.0 | 0.0 | 0.0 | 0.0 |

FIG. 89

FANCF-parental

| untreated | $C_6$ | $C_7$ | $C_8$ | $C_{11}$ | indel % |
|---|---|---|---|---|---|
| A | 0.0% | 0.0% | 0.0% | 0.0% | 0.03% |
| C | 99.9% | 99.9% | 99.9% | 99.9% | |
| G | 0.0% | 0.0% | 0.0% | 0.0% | |
| T | 0.1% | 0.1% | 0.1% | 0.0% | |

| BE1 | $C_6$ | $C_7$ | $C_8$ | $C_{11}$ | indel % |
|---|---|---|---|---|---|
| A | 0.5% | 0.5% | 0.3% | 0.0% | 0.13% |
| C | 94.2% | 97.8% | 97.9% | 99.8% | |
| G | 0.7% | 0.0% | 0.0% | 0.0% | |
| T | 4.7% | 1.6% | 1.8% | 0.2% | |

| BE2 | $C_6$ | $C_7$ | $C_8$ | $C_{11}$ | indel % |
|---|---|---|---|---|---|
| A | 0.3% | 0.4% | 0.2% | 0.0% | 0.25% |
| C | 95.3% | 97.3% | 97.6% | 99.8% | |
| G | 0.4% | 0.1% | 0.0% | 0.0% | |
| T | 4.0% | 2.3% | 2.1% | 0.1% | |

| BE3 | $C_6$ | $C_7$ | $C_8$ | $C_{11}$ | indel % |
|---|---|---|---|---|---|
| A | 2.4% | 3.2% | 2.2% | 0.9% | 18.88% |
| C | 60.3% | 72.6% | 73.8% | 86.6% | |
| G | 1.2% | 0.6% | 0.4% | 0.3% | |
| T | 36.2% | 23.6% | 23.5% | 12.3% | |

FANCF-UDG KO

| untreated | $C_6$ | $C_7$ | $C_8$ | $C_{11}$ | indel % |
|---|---|---|---|---|---|
| A | 0.0% | 0.0% | 0.0% | 0.0% | 0.02% |
| C | 99.9% | 99.9% | 100.0% | 100.0% | |
| G | 0.0% | 0.0% | 0.0% | 0.0% | |
| T | 0.1% | 0.0% | 0.0% | 0.0% | |

| BE1 | $C_6$ | $C_7$ | $C_8$ | $C_{11}$ | indel % |
|---|---|---|---|---|---|
| A | 0.0% | 0.1% | 0.0% | 0.0% | 0.09% |
| C | 60.9% | 61.1% | 61.3% | 94.7% | |
| G | 0.1% | 0.1% | 0.1% | 0.0% | |
| T | 39.0% | 38.8% | 38.6% | 5.2% | |

| BE2 | $C_6$ | $C_7$ | $C_8$ | $C_{11}$ | indel % |
|---|---|---|---|---|---|
| A | 0.0% | 0.0% | 0.0% | 0.0% | 0.02% |
| C | 88.6% | 88.6% | 88.7% | 98.9% | |
| G | 0.0% | 0.0% | 0.0% | 0.0% | |
| T | 11.4% | 11.4% | 11.3% | 1.1% | |

| BE3 | $C_6$ | $C_7$ | $C_8$ | $C_{11}$ | indel % |
|---|---|---|---|---|---|
| A | 0.0% | 0.1% | 0.1% | 0.0% | 0.35% |
| C | 47.9% | 48.5% | 48.8% | 55.8% | |
| G | 0.0% | 0.1% | 0.3% | 0.2% | |
| T | 52.1% | 51.3% | 50.8% | 44.0% | |

FIG. 90B

HEK3-parental

| untreated | C₃ | C₄ | C₅ | C₉ | indel % |
|---|---|---|---|---|---|
| A | 0.0% | 0.0% | 0.0% | 0.0% | 0.00% |
| C | 100.0% | 99.9% | 99.9% | 100.0% | |
| G | 0.0% | 0.0% | 0.0% | 0.0% | |
| T | 0.0% | 0.0% | 0.0% | 0.0% | |

| BE1 | C₃ | C₄ | C₅ | C₉ | indel % |
|---|---|---|---|---|---|
| A | 0.0% | 0.4% | 0.3% | 0.1% | 0.07% |
| C | 99.9% | 96.3% | 94.4% | 99.8% | |
| G | 0.0% | 0.1% | 1.9% | 0.1% | |
| T | 0.1% | 3.2% | 3.4% | 0.1% | |

| BE2 | C₃ | C₄ | C₅ | C₉ | indel % |
|---|---|---|---|---|---|
| A | 0.0% | 0.2% | 0.3% | 0.1% | 0.05% |
| C | 100.0% | 97.7% | 96.1% | 99.8% | |
| G | 0.0% | 0.0% | 1.2% | 0.1% | |
| T | 0.0% | 2.1% | 2.4% | 0.1% | |

| BE3 | C₃ | C₄ | C₅ | C₉ | indel % |
|---|---|---|---|---|---|
| A | 0.1% | 2.9% | 2.4% | 0.3% | 3.27% |
| C | 99.4% | 62.6% | 55.9% | 98.8% | |
| G | 0.0% | 1.5% | 10.4% | 0.3% | |
| T | 0.6% | 33.0% | 31.3% | 0.6% | |

HEK3-UDG KO

| untreated | C₃ | C₄ | C₅ | C₉ | indel % |
|---|---|---|---|---|---|
| A | 0.0% | 0.0% | 0.0% | 0.0% | 0.00% |
| C | 100.0% | 100.0% | 100.0% | 100.0% | |
| G | 0.0% | 0.0% | 0.0% | 0.0% | |
| T | 0.0% | 0.0% | 0.0% | 0.0% | |

| BE1 | C₃ | C₄ | C₅ | C₉ | indel % |
|---|---|---|---|---|---|
| A | 0.0% | 0.0% | 0.0% | 0.0% | 0.03% |
| C | 96.0% | 50.3% | 41.1% | 96.3% | |
| G | 0.0% | 0.0% | 0.1% | 0.1% | |
| T | 4.0% | 49.6% | 58.8% | 3.6% | |

| BE2 | C₃ | C₄ | C₅ | C₉ | indel % |
|---|---|---|---|---|---|
| A | 0.0% | 0.0% | 0.0% | 0.0% | 0.00% |
| C | 99.0% | 80.2% | 73.2% | 98.8% | |
| G | 0.0% | 0.0% | 0.0% | 0.0% | |
| T | 1.0% | 19.7% | 26.8% | 1.1% | |

| BE3 | C₃ | C₄ | C₅ | C₉ | indel % |
|---|---|---|---|---|---|
| A | 0.0% | 0.0% | 0.0% | 0.0% | 0.09% |
| C | 98.5% | 55.6% | 40.3% | 99.4% | |
| G | 0.0% | 0.0% | 0.0% | 0.0% | |
| T | 1.4% | 44.3% | 59.7% | 0.6% | |

FIG. 90C

HEK4-parental

| | | $C_3$ | $C_5$ | $C_8$ | $C_{11}$ | indel % |
|---|---|---|---|---|---|---|
| untreated | A | 0.0% | 0.0% | 0.0% | 0.0% | 0.00% |
| | C | 100.0% | 100.0% | 99.9% | 100.0% | |
| | G | 0.0% | 0.0% | 0.0% | 0.0% | |
| | T | 0.0% | 0.0% | 0.1% | 0.0% | |
| BE1 | A | 0.0% | 1.4% | 0.0% | 0.0% | 0.08% |
| | C | 100.0% | 95.5% | 99.9% | 100.0% | |
| | G | 0.0% | 2.2% | 0.0% | 0.0% | |
| | T | 0.0% | 0.9% | 0.1% | 0.0% | |
| BE2 | A | 0.0% | 0.4% | 0.0% | 0.0% | 0.07% |
| | C | 100.0% | 97.7% | 99.9% | 100.0% | |
| | G | 0.0% | 1.1% | 0.0% | 0.0% | |
| | T | 0.0% | 0.7% | 0.1% | 0.0% | |
| BE3 | A | 0.0% | 7.1% | 0.0% | 0.0% | 6.05% |
| | C | 99.9% | 58.5% | 99.7% | 100.0% | |
| | G | 0.0% | 17.4% | 0.0% | 0.0% | |
| | T | 0.1% | 17.0% | 0.2% | 0.0% | |

HEK4-UDG KO

| | | $C_3$ | $C_5$ | $C_8$ | $C_{11}$ | indel % |
|---|---|---|---|---|---|---|
| untreated | A | 0.0% | 0.0% | 0.0% | 0.0% | 0.00% |
| | C | 100.0% | 100.0% | 99.9% | 100.0% | |
| | G | 0.0% | 0.0% | 0.0% | 0.0% | |
| | T | 0.0% | 0.0% | 0.1% | 0.0% | |
| BE1 | A | 0.0% | 0.0% | 0.0% | 0.0% | 0.00% |
| | C | 99.9% | 67.5% | 99.0% | 100.0% | |
| | G | 0.0% | 0.0% | 0.1% | 0.0% | |
| | T | 0.1% | 32.5% | 1.0% | 0.0% | |
| BE2 | A | 0.0% | 0.0% | 0.0% | 0.0% | 0.00% |
| | C | 100.0% | 91.9% | 99.7% | 100.0% | |
| | G | 0.0% | 0.0% | 0.1% | 0.0% | |
| | T | 0.0% | 8.1% | 0.2% | 0.0% | |
| BE3 | A | 0.0% | 0.0% | 0.0% | 0.0% | 0.03% |
| | C | 99.9% | 65.9% | 99.7% | 100.0% | |
| | G | 0.0% | 0.3% | 0.0% | 0.0% | |
| | T | 0.1% | 33.8% | 0.3% | 0.0% | |

FIG. 90D

| Species | PAM | Base editor | Reference |
|---|---|---|---|
| S. pyogenes | NGG | BE3 | Wild-type |
| | NGA | VQR, EQR BE3 | Ref #7 |
| | NGCG | VRER BE3 | Ref #7 |
| S. aureus | NNGRRT | SaBE3 | Wild-type |
| | NNNRRT | SaKKHBE3 | Ref #8 |

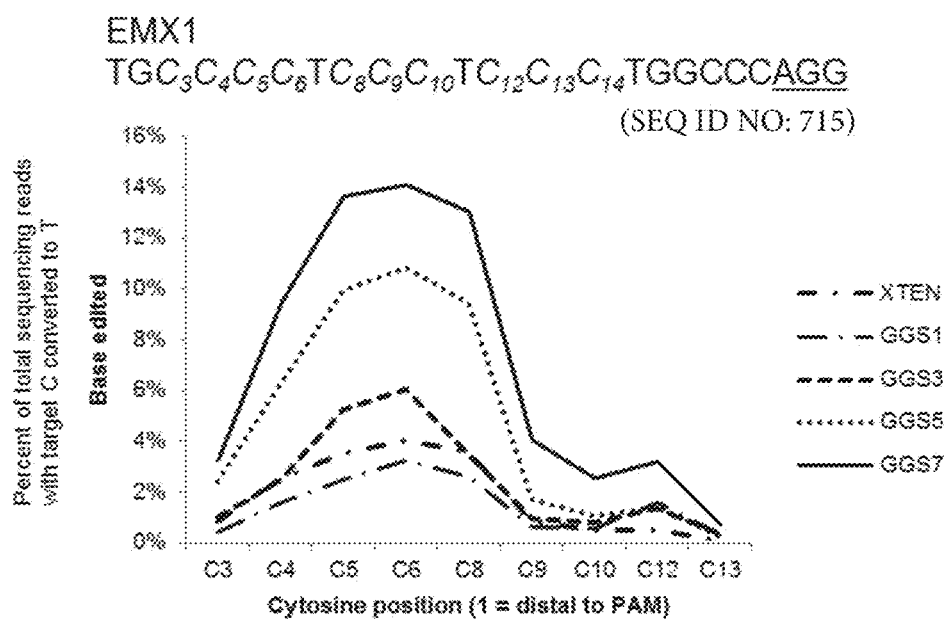
FIG. 96
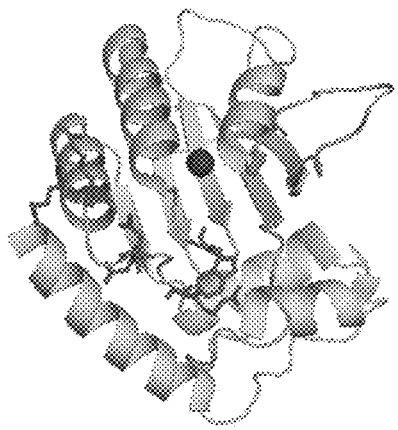
FIG. 97A
| APOBEC1 mutation | APOBEC3G mutation | Reference |
|---|---|---|
| R126A | R320A | #9,10 |
| R126E | R320E | #9,10 |
| W90A | W285A | #9,10 |
| W90Y | W285Y | This work |
| R132E | R326E | This work |
FIG. 97B

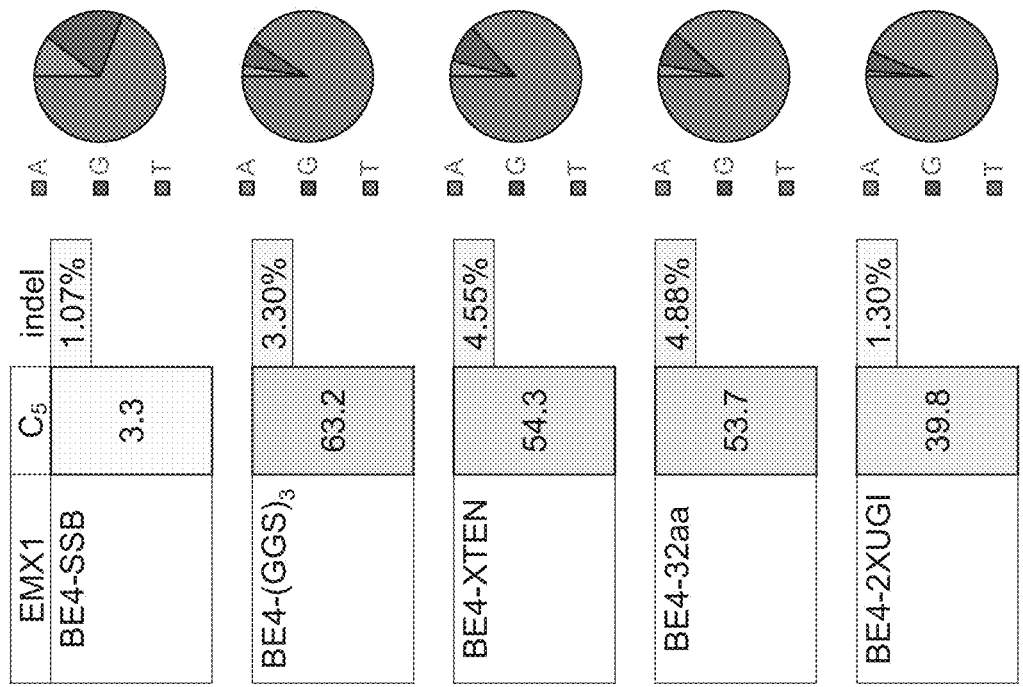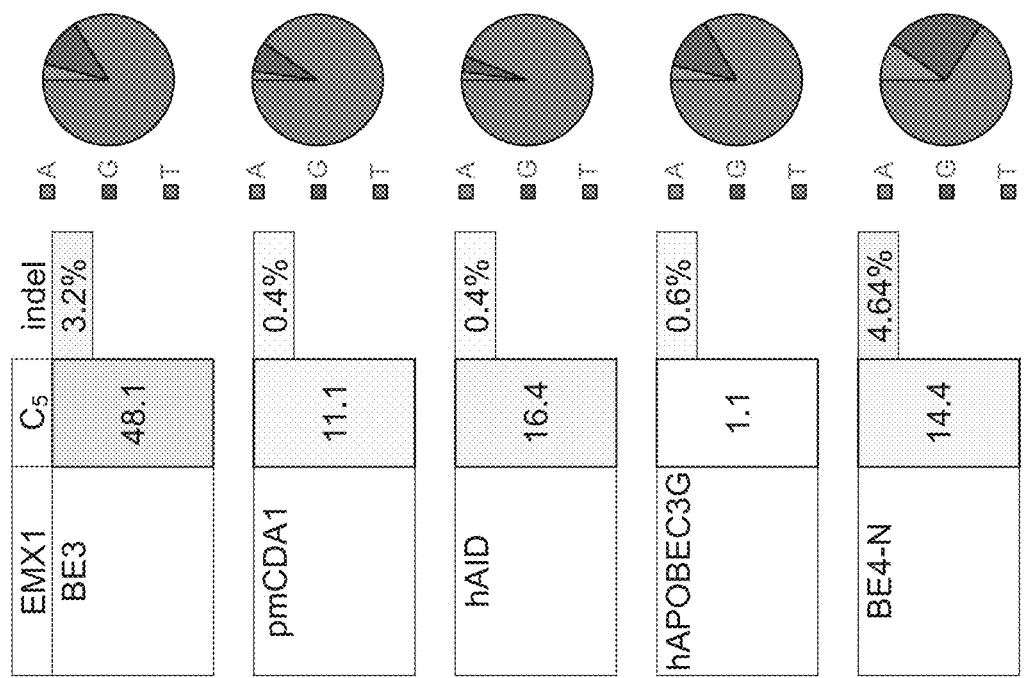
FIG.110

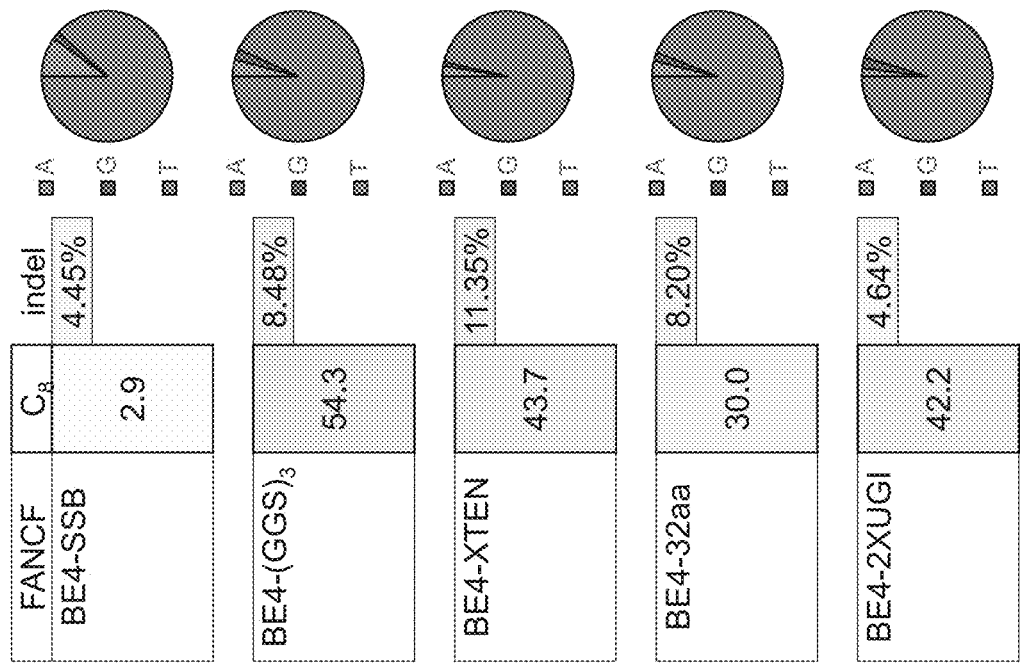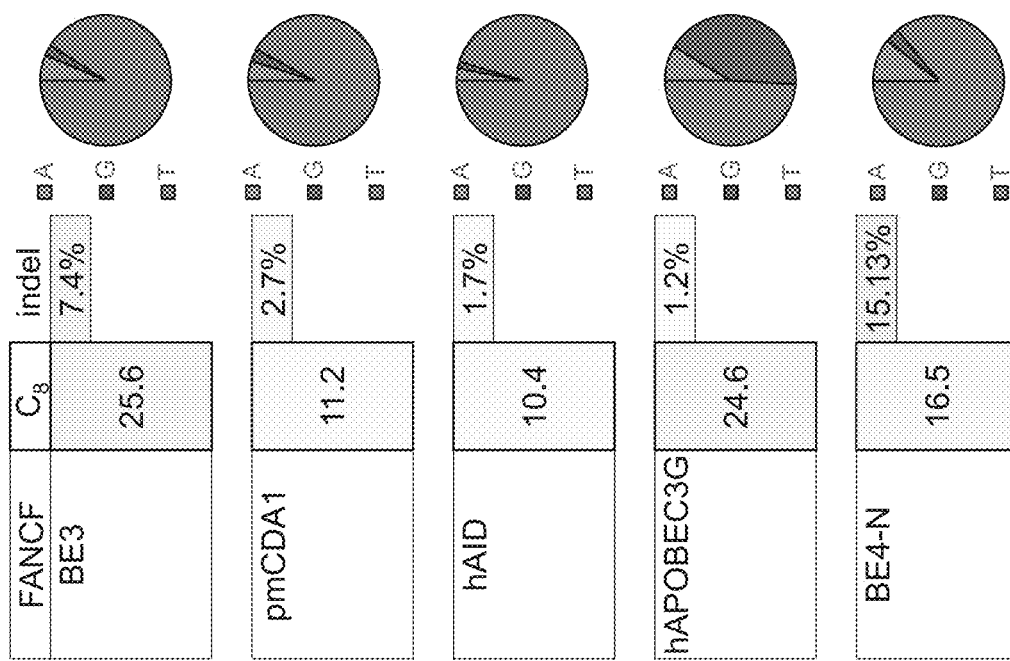
FIG. 111

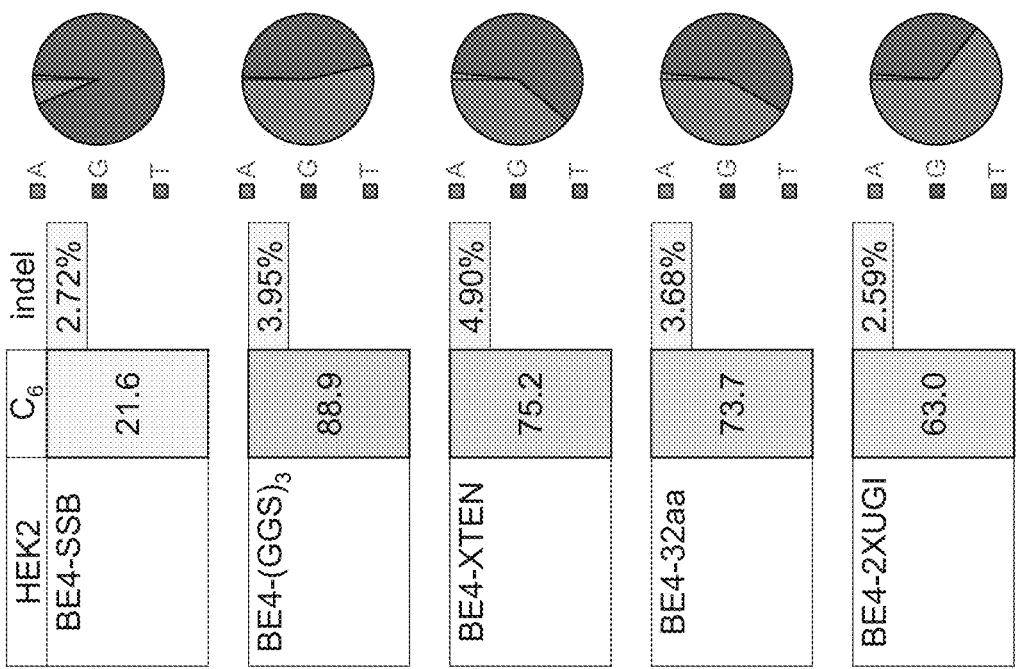
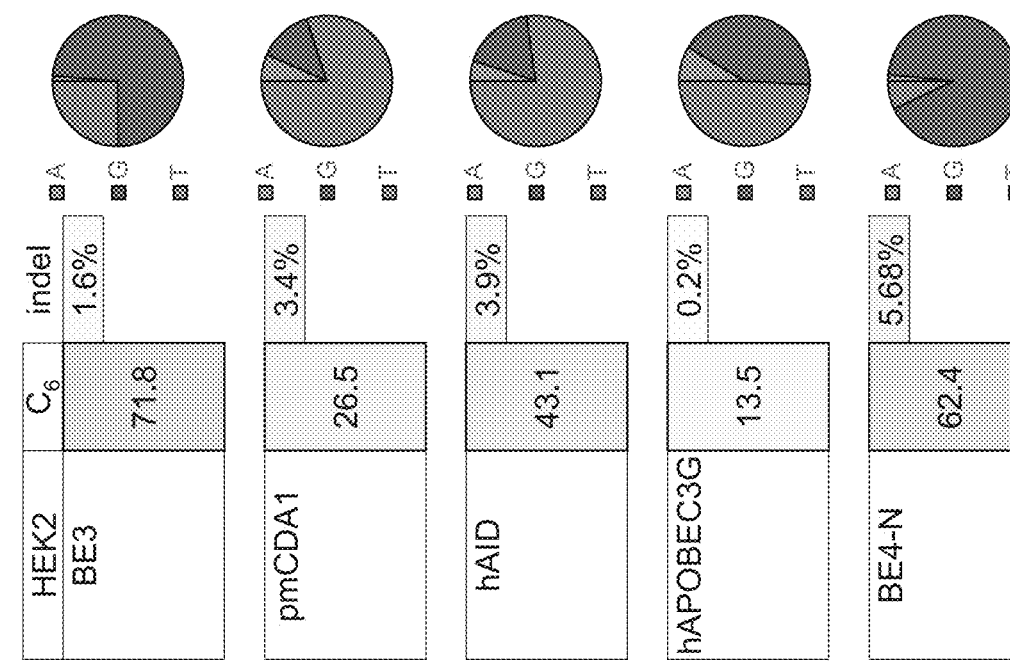
FIG. 112

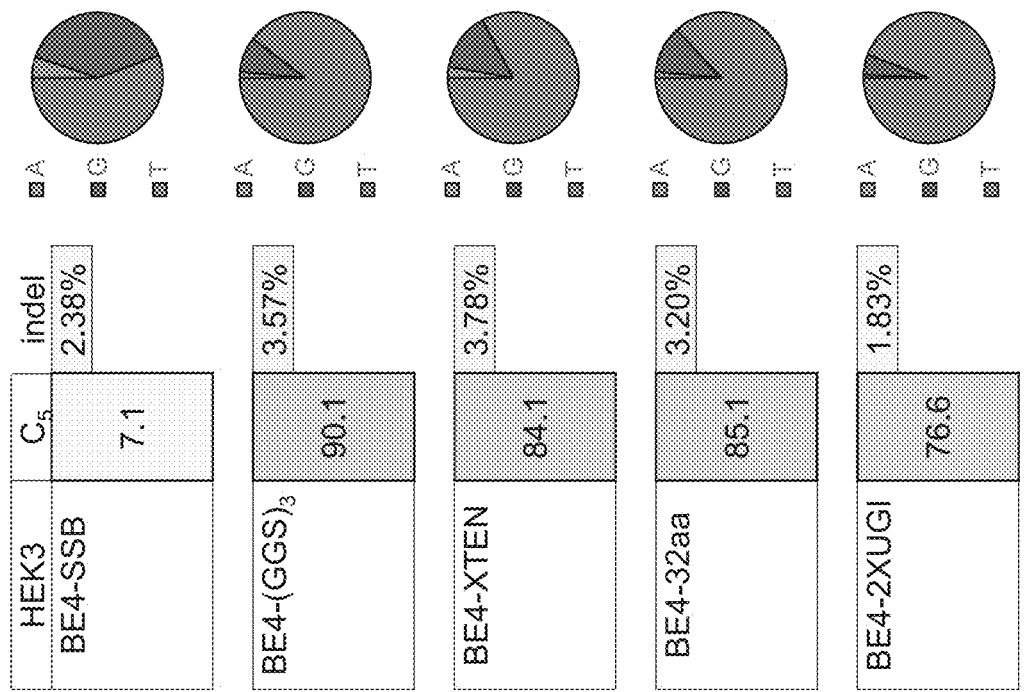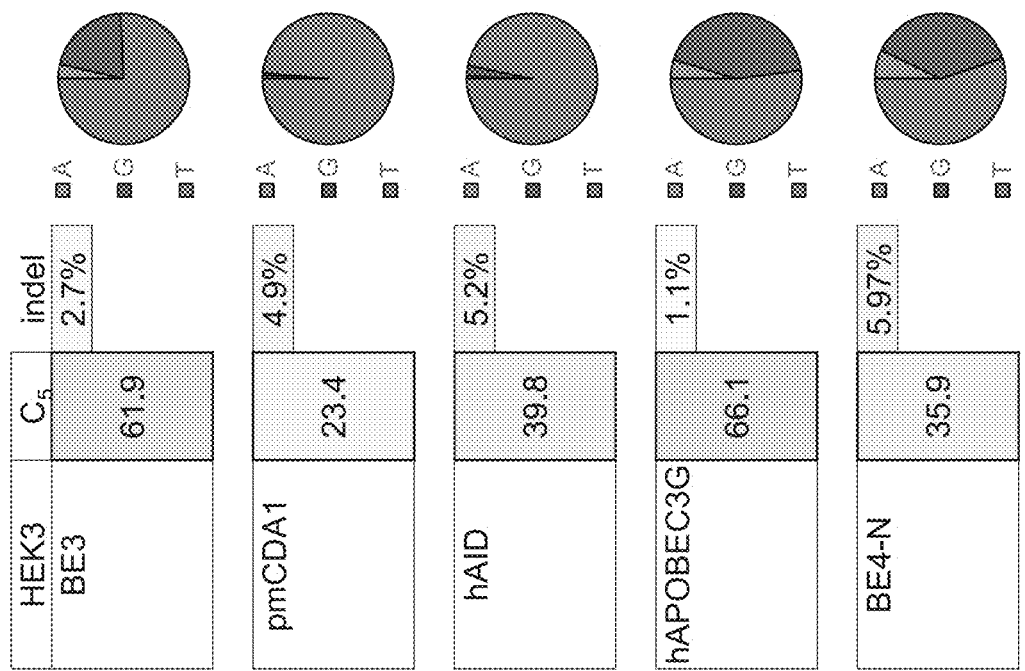
FIG. 113

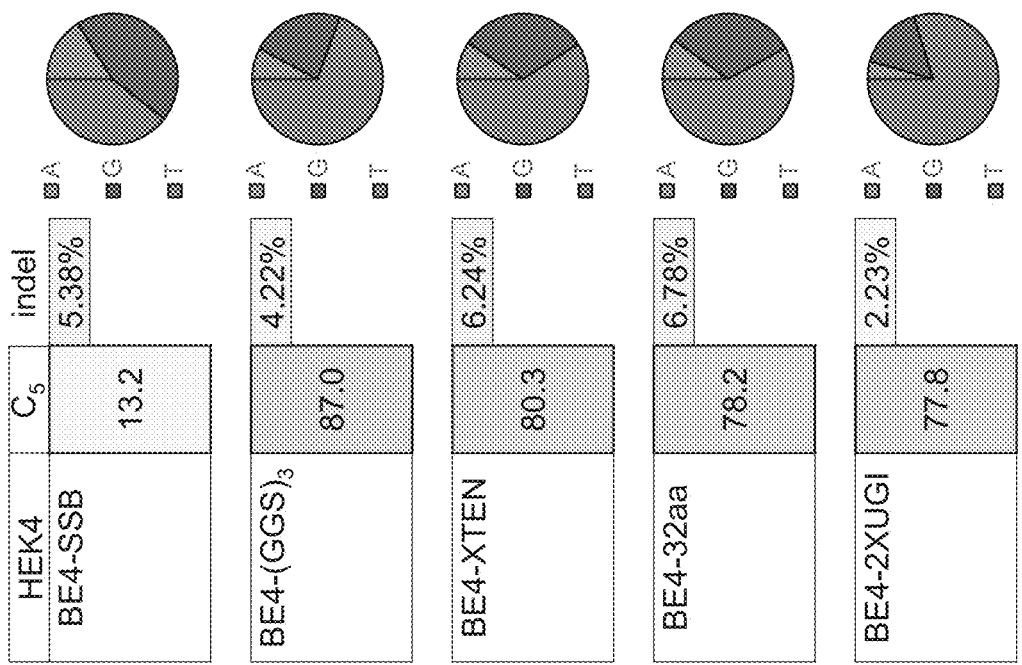
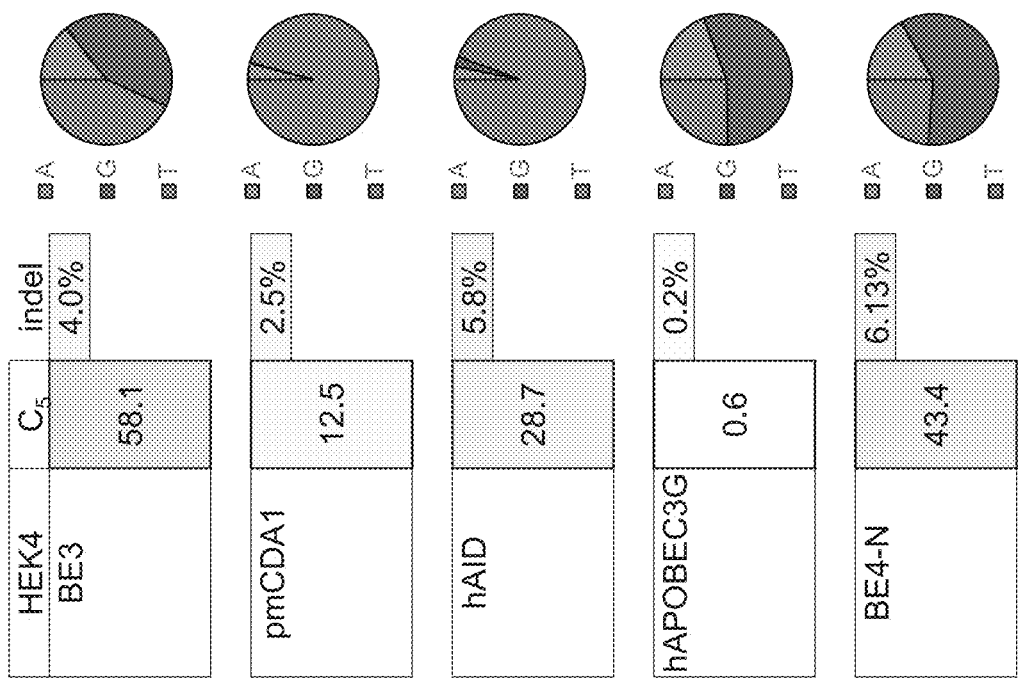
FIG. 114

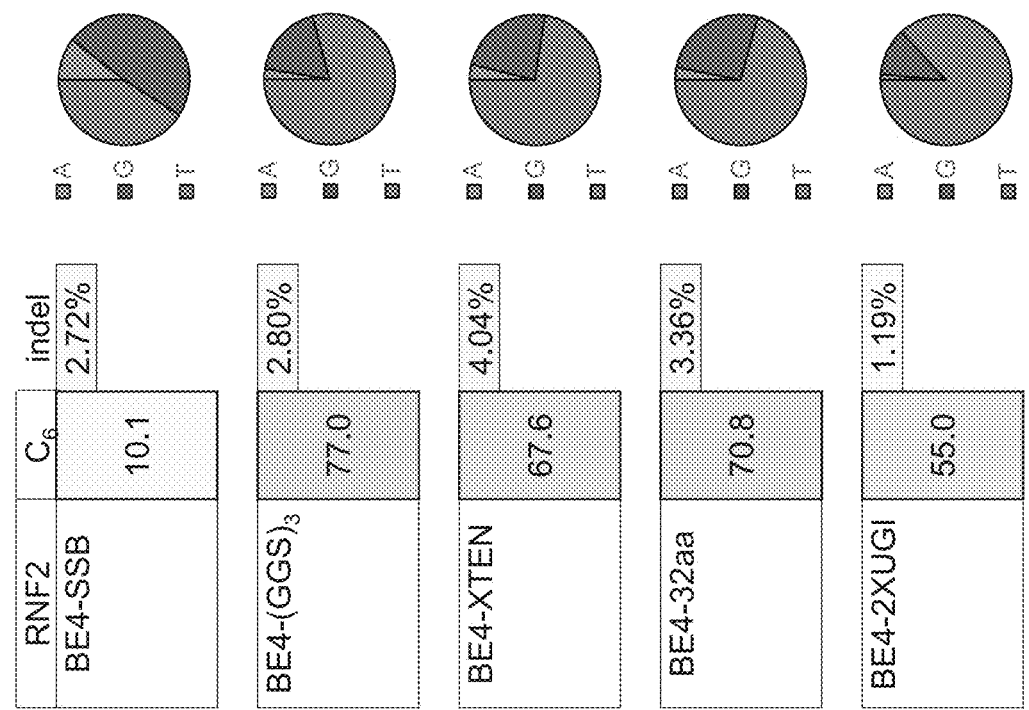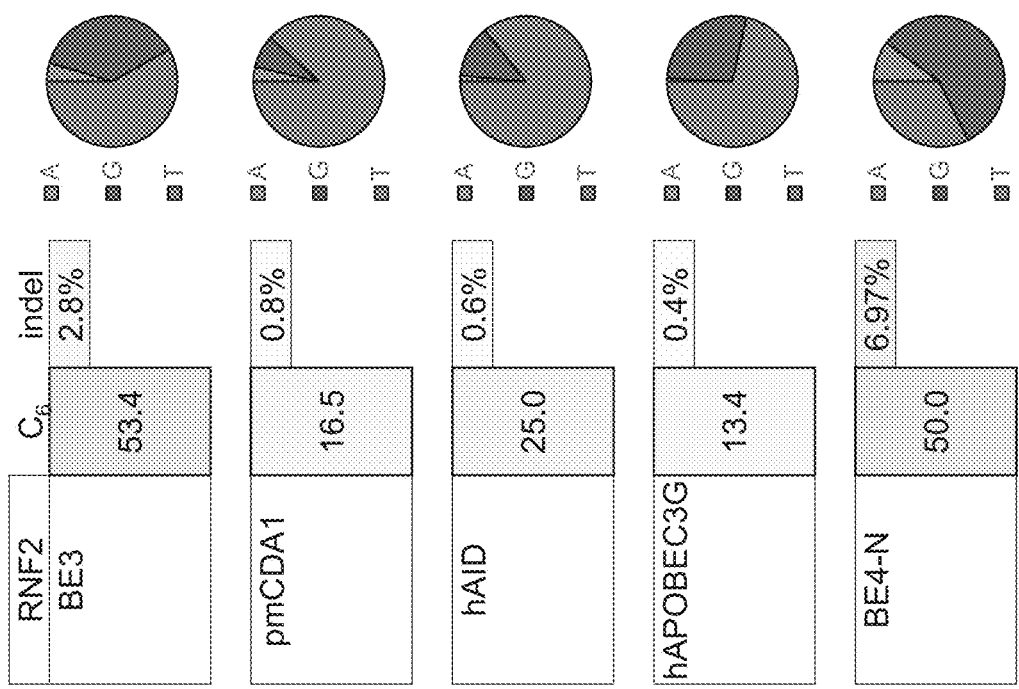
FIG. 115

Top strand: non-target strand; Bottom strand: target strand

FIG. 118

BG –background; R912A – BE 3 ; R1225A –self-defeating BE (nicks non-target strand)

EMX1 on-target : GAGTCCGAGCAGAAGAAGAAGGG (SEQ ID NO: 480)

EMX1 off-target 1: GAGTCTAAGCAGAAGAAGAAGAG (SEQ ID NO: 481)
EMX1 off-target 2: GAGGCCGAGCAGAAGAAAGACGG (SEQ ID NO: 482)
EMX1 off-target 3: GAGTCCTAGCAGGAGAAGAAGAG (SEQ ID NO: 483)

EMX1: GAGTC$_4$C$_5$GAGCAGAAGAAGAAGGG (SEQ ID NO: 480)
EMX1 off target 1: GAGTC$_4$TAAGCAGAAGAAGAAGAG (SEQ ID NO: 481)

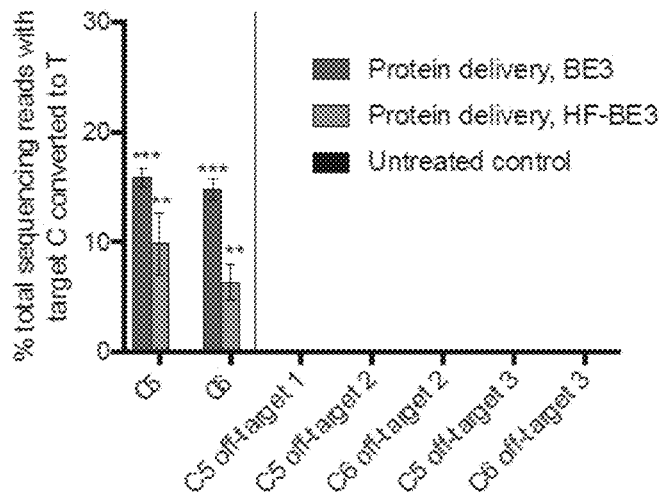

EMX1 on-target : GAGTC C GAGCAGAAGAAGAAGGG (SEQ ID NO: 480)

EMX1 off-target 1: GAGTC TAAGCAGAAGAAGAAGAG (SEQ ID NO: 481)
EMX1 off-target 2: GAGGC C GAGCAGAAGAAAGACGG (SEQ ID NO: 482)
EMX1 off-target 3: GAGTC C TAGCAGGAGAAGAAGAG (SEQ ID NO: 483)

FIG. 130A

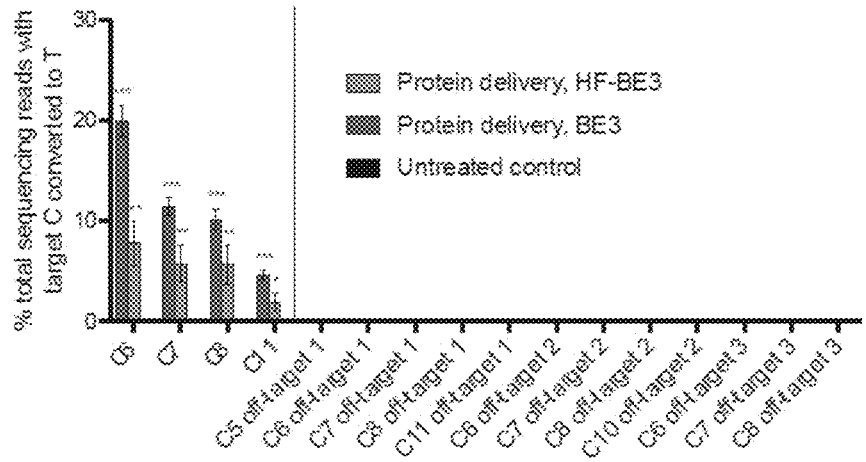

FANCF on-target: GGAATC C C TTC TGCAGCACCTGG (SEQ ID NO: 493)

FANCF off-target 1: GGAAC C C C GTC TGCAGCACCAGG (SEQ ID NO: 494)
FANCF off-target 2: GGAGTC C C TC C TACAGCACCAGG (SEQ ID NO: 495)
FANCF off-target 3: AGAGGC C C C TC TGCAGCACCAGG (SEQ ID NO: 496)

FIG. 130B

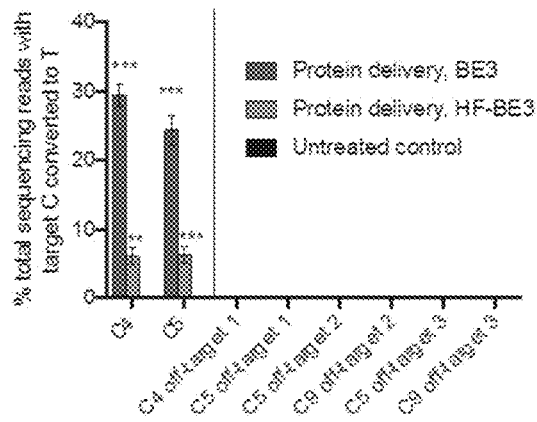

HEK293 site 3 on-target: GCCC$_4$C$_5$AGACTGAGCACGTGATGG (SEQ ID NO: 779)

HEK293 site 3 off-target 1: CACC$_4$C$_5$AGACTGAGCACGTGCTGG (SEQ ID NO: 485)
HEK293 site 3 off-target 2: GACAC$_5$AGACTGGGCACGTGAGGG (SEQ ID NO: 486)
HEK293 site 3 off-target 3: AGCTC$_5$AGACTGAGCAAGTGAGGG (SEQ ID NO: 487)

FIG. 130C

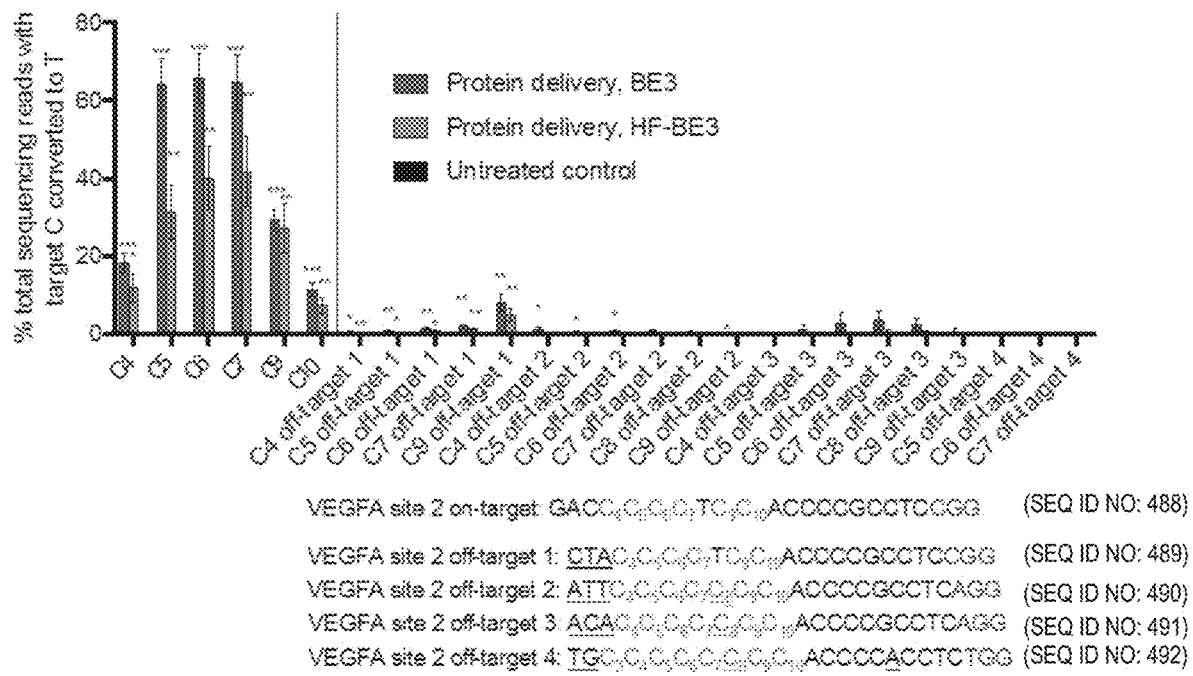

VEGFA site 2 on-target: GACC$_4$C$_5$C$_6$C$_7$TC$_9$C$_{10}$ACCCGCCTCCGG (SEQ ID NO: 488)
VEGFA site 2 off-target 1: CTAC$_5$C$_6$C$_7$TC$_9$C$_{10}$ACCCGCCTCCGG (SEQ ID NO: 489)
VEGFA site 2 off-target 2: ATTC$_5$C$_6$C$_7$C$_8$C$_9$ACCCGCCTCAGG (SEQ ID NO: 490)
VEGFA site 2 off-target 3: ACAC$_5$C$_6$C$_7$C$_8$C$_9$ACCCGCCTCAGG (SEQ ID NO: 491)
VEGFA site 2 off-target 4: TGC$_4$C$_5$C$_6$C$_7$C$_8$C$_9$ACCCACCTCTGG (SEQ ID NO: 492)

FIG. 130D

TYR1: GTC₂AGGTC₅GAGGGTTCTGTCAGG (SEQ ID NO: 564)
TYR2: CTTC₄C₅AGGATGAGAACACAGAGG (SEQ ID NO: 565)
TYR3: CAAC₃C₅AC₇TGCTCAAAGATGCTGG (SEQ ID NO: 566)

VEGFA site 2: GACC$_4$C$_5$C$_6$C$_7$TC$_9$C$_{10}$ACCCCGCCTCCGG
(SEQ ID NO: 488)

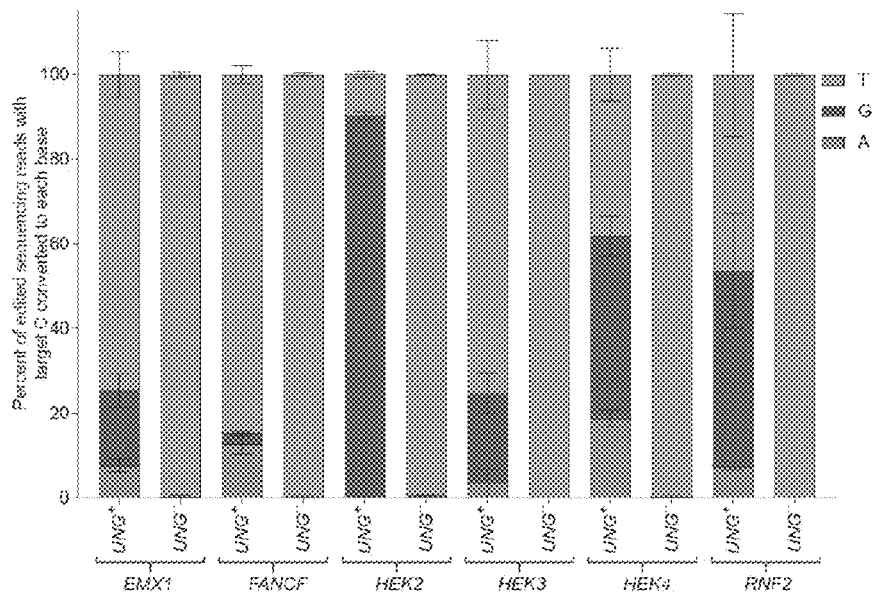
FIG. 135A
| | | |
|---|---|---|
| EMX1: | GAGTC₆CGAGCAGAAGAAGAAGGG | (SEQ ID NO: 480) |
| FANCF: | GGAATCC₆CTTCTGCAGCACCTGG | (SEQ ID NO: 493) |
| HEK2: | GAACAC₆AAAGCATAGACTGCGGG | (SEQ ID NO: 780) |
| HEK3: | GGCCC₆AGACTGAGCACGTGATGG | (SEQ ID NO: 781) |
| HEK4: | GGCAC₆TGCGGCTGGAGGTCCGGG | (SEQ ID NO: 782) |
| RNF2: | GTCATC₆TTAGTCATTACCTGAGG | (SEQ ID NO: 783) |
FIG. 135B
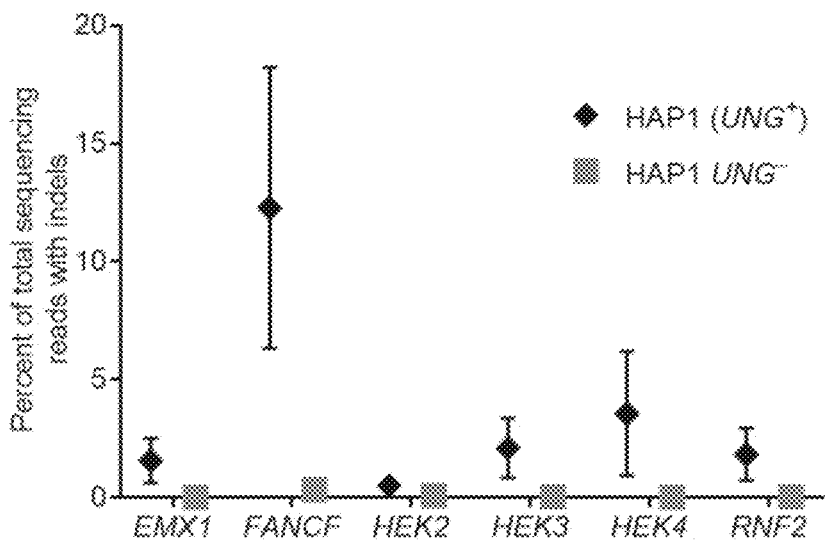
FIG. 135C

FIG. 136A

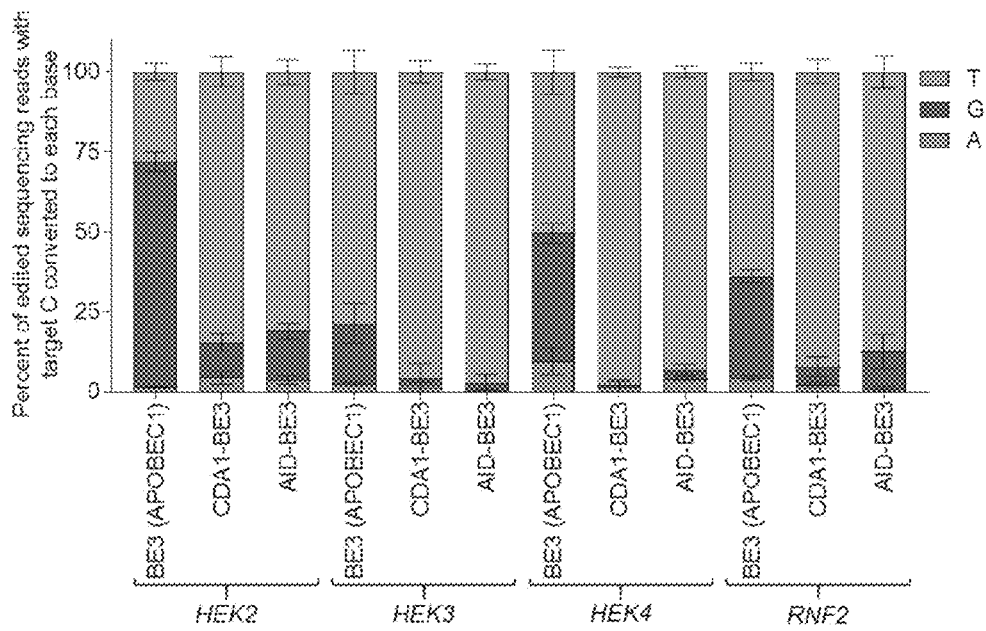
FIG. 136B
| | | |
|---|---|---|
| *HEK2:* | GAACAC₅AAAGCATAGACTGCGGG | (SEQ ID NO: 780) |
| *HEK3:* | GGCCC₄AGACTGAGCACGTGATGG | (SEQ ID NO: 781) |
| *HEK4:* | GGCAC₅TGCGGCTGGAGGTCCGGG | (SEQ ID NO: 782) |
| *RNF2:* | GTCATC₆TTAGTCATTACCTGAGG | (SEQ ID NO: 783) |
FIG. 136C
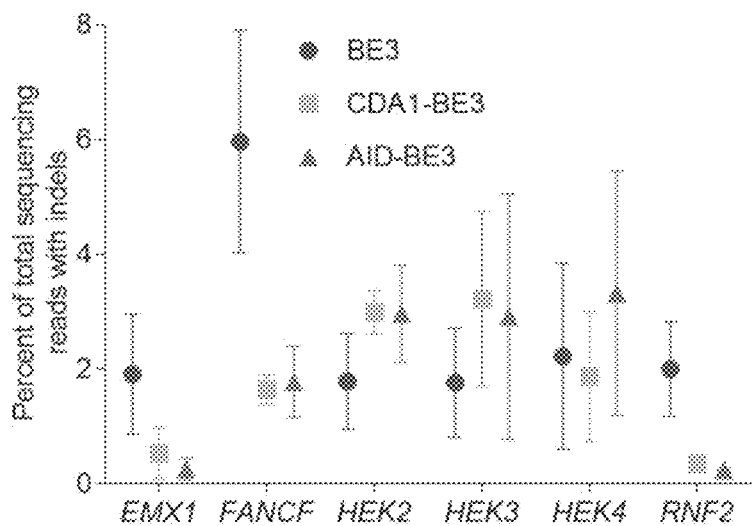
FIG. 136D

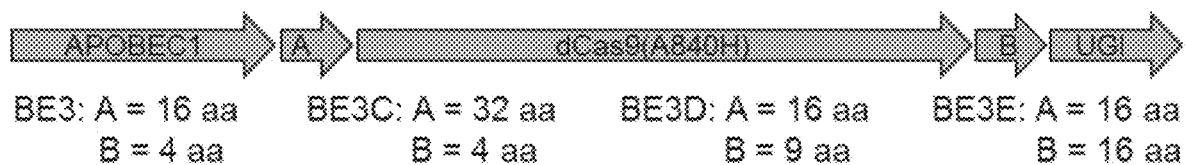
FIG. 138A
| | | |
|---|---|---|
| HEK2: | GAAC₄AC₆AAAGCATAGACTGCGGG | (SEQ ID NO: 780) |
| HEK3: | GGCC₄C₆AGACTGAGCACGTGATGG | (SEQ ID NO: 781) |
| HEK4: | GGCAC₅TGCGGCTGGAGGTCCGGG | (SEQ ID NO: 782) |
| RNF2: | GTC₃ATC₆TTAGTCATTACCTGAGG | (SEQ ID NO: 783) |
FIG. 138B
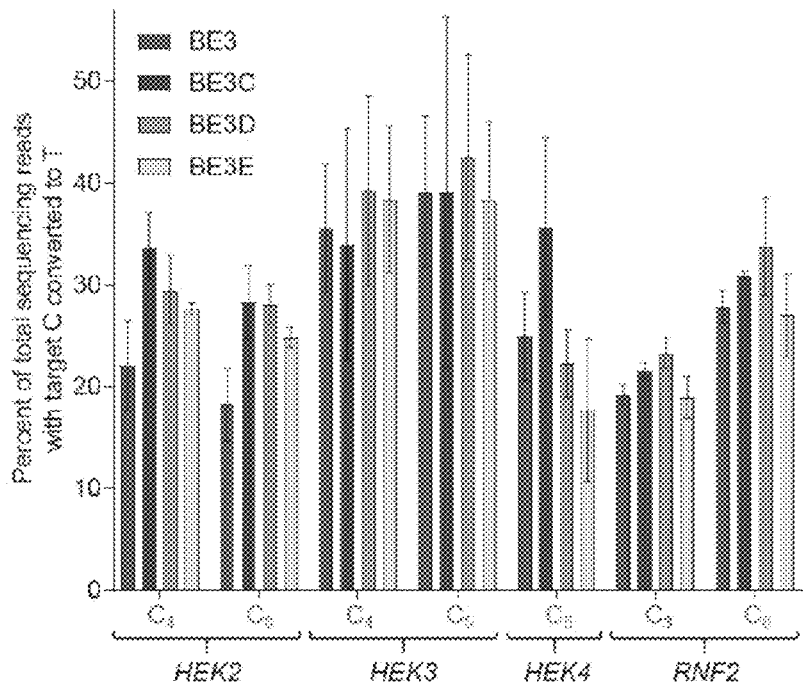
FIG. 138C

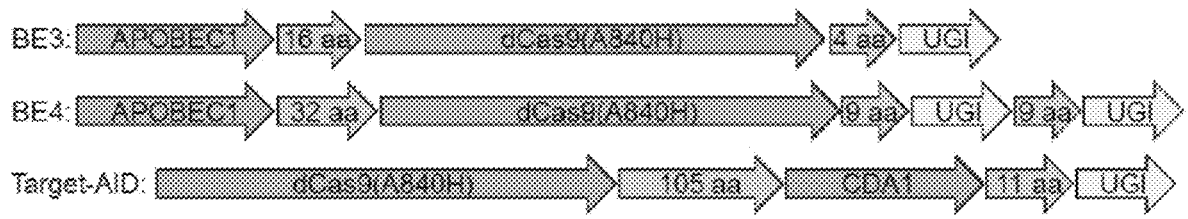
FIG. 139A
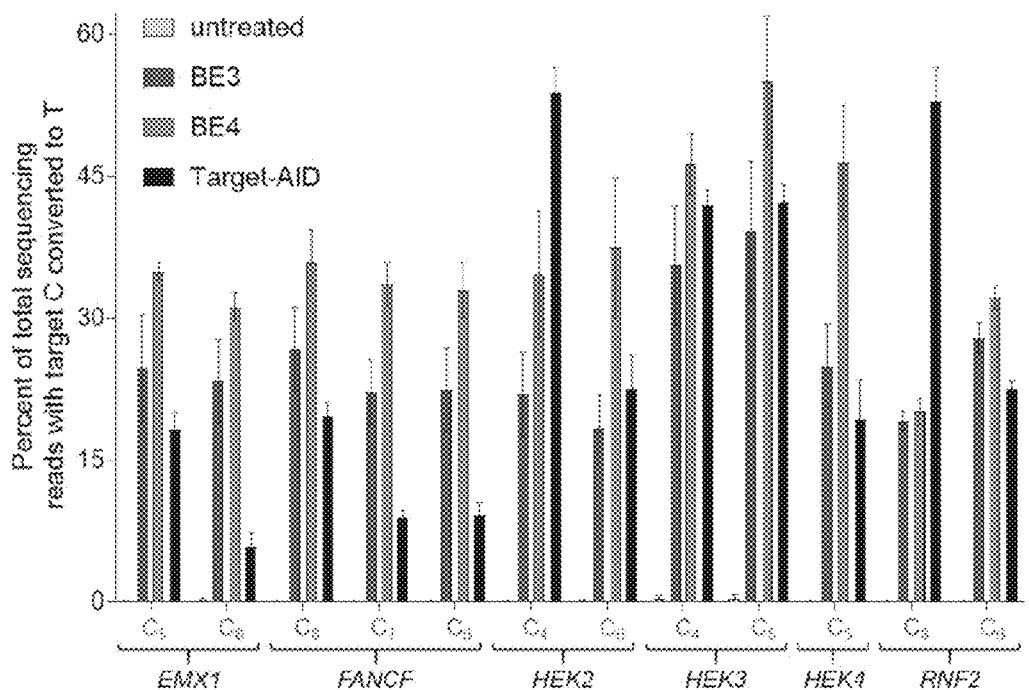
FIG. 139B
FIG. 139C

| | | |
|---|---|---|
| *EMX1*: | GAGTC₅C₆GAGCAGAAGAAGAAGGG | (SEQ ID NO: 480) |
| *FANCF*: | GGAATC₄C₅C₆TTCTGCAGCACCTGG | (SEQ ID NO: 493) |
| *HEK2*: | GAAC₄AC₆AAAGCATAGACTGCGGG | (SEQ ID NO: 780) |
| *HEK3*: | GGC₃C₄C₅AGACTGAGCACGTGATGG | (SEQ ID NO: 781) |
| *HEK4*: | GGC₃AC₅TGC₈GGCTGGAGGTCCGGG | (SEQ ID NO: 782) |
| *RNF2*: | GTC₃ATC₆TTAGTCATTACCTGAGG | (SEQ ID NO: 783) |

FIG. 140A

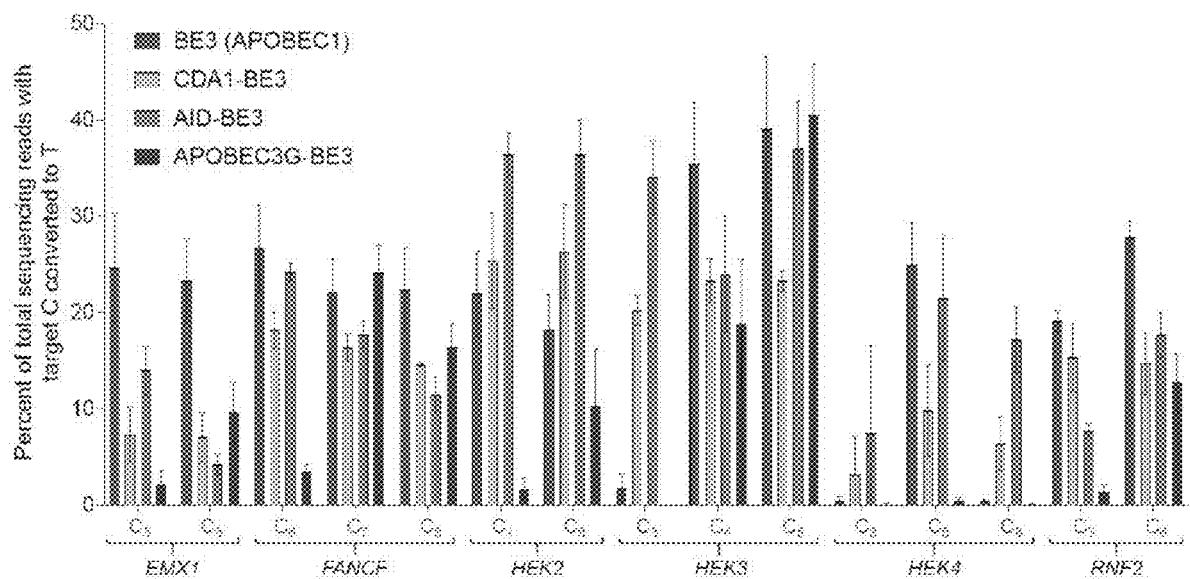

FIG. 140B

| | Percent of cleanly edited reads with given sequence | | |
|---|---|---|---|
| *HEK2* protospacer sequence | BE3 | CDA1-BE3 | AID-BE3 |
| GAAT₄AT₆AAAGCATAGACTGCGGG (SEQ ID NO: 784) | 77 ± 1 | 88 ± 2 | 92 ± 2 |
| GAAC₄AT₆AAAGCATAGACTGCGGG (SEQ ID NO: 785) | 23 ± 1 | 5 ± 1 | 4 ± 1 |
| GAAT₄AC₆AAAGCATAGACTGCGGG (SEQ ID NO: 786) | 0 ± 0 | 7 ± 2 | 4 ± 2 |

FIG. 140C

| | | |
|---|---|---|
| *EMX1*: | GAGTC$_5$C$_6$GAGCAGAAGAAGAAGGG | (SEQ ID NO: 480) |
| *FANCF*: | GGAATC$_6$C$_7$C$_9$TTCTGCAGCACCTGG | (SEQ ID NO: 493) |
| *HEK2*: | GAAC$_4$AC$_6$AAAGCATAGACTGCGGG | (SEQ ID NO: 780) |
| *HEK3*: | GGCC$_4$C$_5$AGACTGAGCACGTGATGG | (SEQ ID NO: 781) |
| *HEK4*: | GGCAC$_5$TGCGGCTGGAGGTCCGGG | (SEQ ID NO: 782) |
| *RNF2*: | GTC$_3$ATC$_6$TTAGTCATTACCTGAGG | (SEQ ID NO: 783) |

HEK2: GAAC₄AC₆AAAGCATAGACTGCGGG (SEQ ID NO: 780)
HEK3: GGCC₄C₅AGACTGAGCACGTGATGG (SEQ ID NO: 781)
HEK4: GGCAC₅TGCGGCTGGAGGTCCGGG (SEQ ID NO: 782)
RNF2: GTC₃ATC₆TTAGTCATTACCTGAGG (SEQ ID NO: 783)

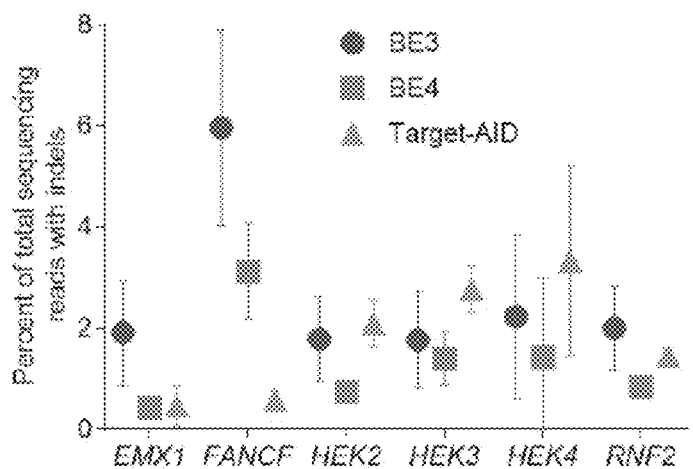
FIG. 144A
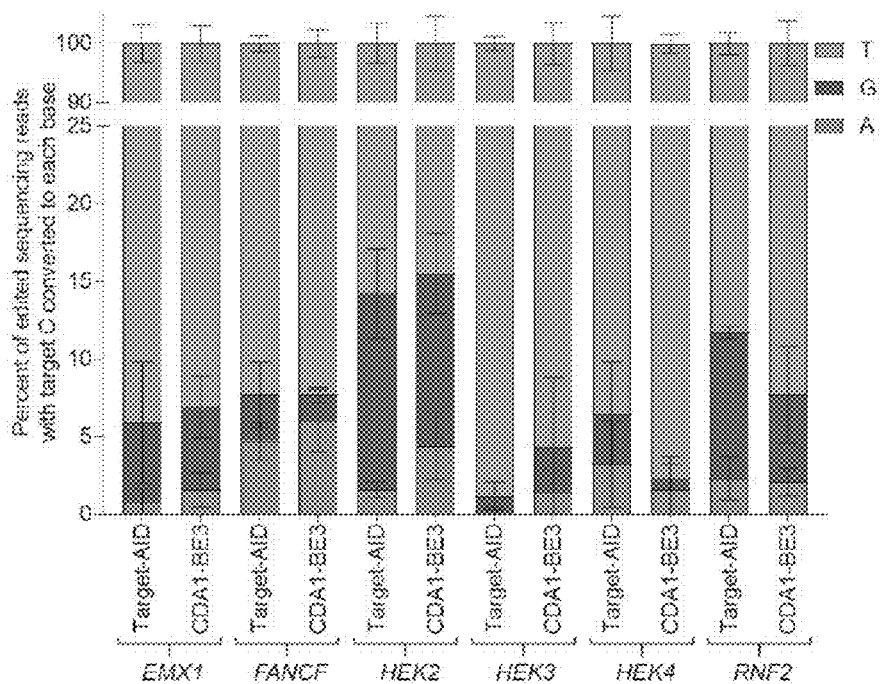
FIG. 144B
| EMX1: | GAGTC$_6$CGAGCAGAAGAAGAAGGG | (SEQ ID NO: 480) |
| FANCF: | GGAATCC$_7$CTTCTGCAGCACCTGG | (SEQ ID NO: 493) |
| HEK2: | GAACAC$_6$AAAGCATAGACTGCGGG | (SEQ ID NO: 780) |
| HEK3: | GGCCC$_5$AGACTGAGCACGTGATGG | (SEQ ID NO: 781) |
| HEK4: | GGCAC$_5$TGCGGCTGGAGGTCCGGG | (SEQ ID NO: 782) |
| RNF2: | GTCATC$_6$TTAGTCATTACCTGAGG | (SEQ ID NO: 783) |
FIG. 144C

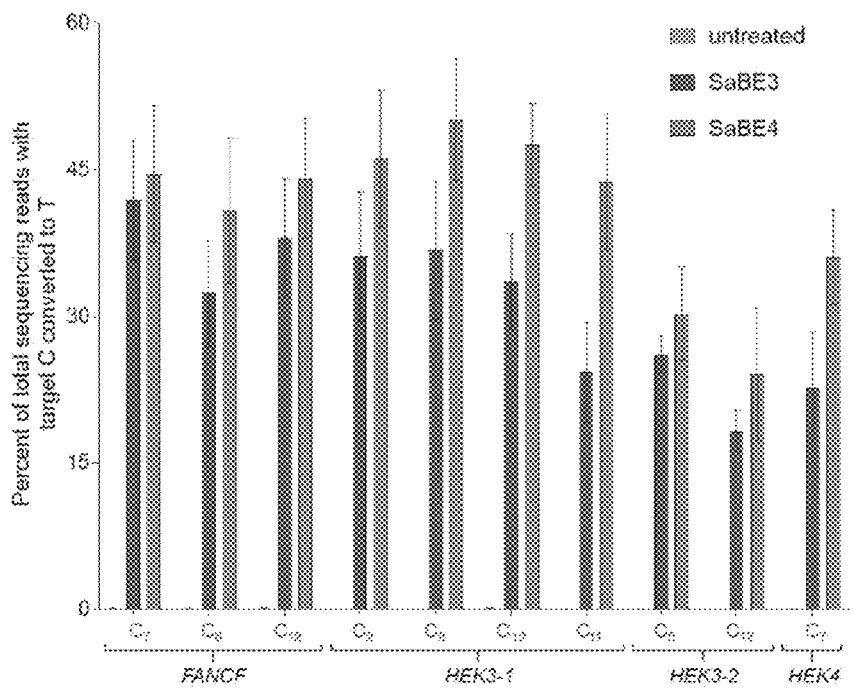
FIG. 145A
| FANCF: | GATGTTC$_7$C$_9$AATC$_{12}$AGTACGCAGAGAGT | (SEQ ID NO: 787) |
| HEK3-1: | TC$_2$TGCTTC$_8$TC$_{10}$C$_{11}$AGCCCTGGCCTGGGT | (SEQ ID NO: 788) |
| HEK3-2: | ACGTGCTC$_8$AGTC$_{12}$TGGGCCCCAAGGAT | (SEQ ID NO: 789) |
| HEK4: | GTGGCAC$_7$TGCGGCTGGAGGTGGGGGT | (SEQ ID NO: 790) |
FIG. 145B
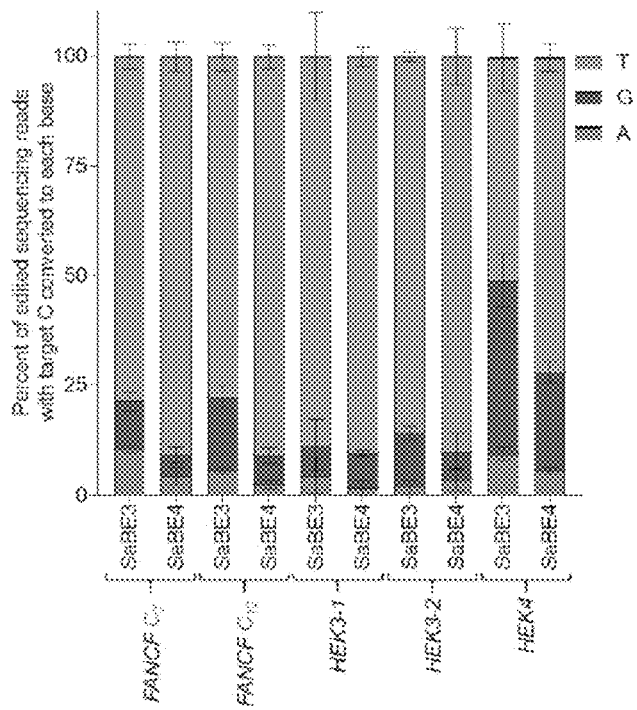
FIG. 145C

FIG. 146

FIG. 147 (SEQ ID NO: 493)

EMX 19

| | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C3 | 0.025 | 0.039 | 2.662 | 0.012 | 0.013 | 0.041 | 0.02 | 0.013 | 0.012 | 0.033 | 0.012 | 0.02 | 0.021 |
| C9 | 20.899 | 13.15 | 10.456 | 27.535 | 18.921 | 13.072 | 19.043 | 1.591 | 3.638 | 29.39 | 14.271 | 20.95 | 13.924 |
| C10 | 20.226 | 10.784 | 5.206 | 26.909 | 16.026 | 6.748 | 18.445 | 1.266 | 2.658 | 28.933 | 2.934 | 13.039 | 3.051 |
| C12 | 20.453 | 11.385 | 9.095 | 26.849 | 16.893 | 9.983 | 18.589 | 1.437 | 3.127 | 29.165 | 8.695 | 18.597 | 9.07 |
| C13 | 6.39 | 3.396 | 1.085 | 8.946 | 4.126 | 1.3 | 6.317 | 0.257 | 0.659 | 18.973 | 0.547 | 3.247 | 0.8 |
| C18 | 4.757 | 2.603 | 2.013 | 5.304 | 3.233 | 1.914 | 2.805 | 0.235 | 0.367 | 4.302 | 0.992 | 1.848 | 0.994 |
| indels (%) | 0.028979 | 6.0862 | 28.9183 | 0.036623 | 9.8557 | 28.6068 | 0.94296 | 1.4573 | 3.78 | 0.024623 | 27.6872 | 13.0741 | 31.3295 |
| C3 | 0.02499276 | 0.03662638 | 1.89219485 | 0.01199537 | 0.01171876 | 0.02927121 | 0.01981141 | 0.01281055 | 0.0115464 | 0.03299187 | 0.00857754 | 0.01738518 | 0.01442081 |
| C9 | 20.8929437 | 12.3496647 | 7.43230255 | 27.5243652 | 17.056203 | 9.33325191 | 18.8634321 | 1.56781436 | 3.5004836 | 29.3827633 | 10.3197597 | 18.2109761 | 9.56168042 |
| C10 | 20.2201387 | 10.1276642 | 3.7005133 | 26.8986069 | 14.4465255 | 4.81761314 | 18.271071 | 1.24755058 | 2.55752276 | 28.9258758 | 2.12165755 | 11.3342681 | 2.09513696 |
| C12 | 20.4470729 | 10.6920861 | 6.46488062 | 26.8386301 | 15.2280766 | 7.12718316 | 18.4137132 | 1.41605186 | 3.00887994 | 29.1578187 | 6.28759796 | 16.1656096 | 6.22841435 |
| C13 | 6.38814824 | 3.18931265 | 0.77123645 | 8.94254479 | 3.71935382 | 0.92811116 | 6.25743322 | 0.25325474 | 0.63406898 | 18.9683283 | 0.39555102 | 2.82248397 | 0.549364 |
| C18 | 4.75562147 | 2.44457621 | 1.43087462 | 5.30195144 | 2.91436522 | 1.36646585 | 2.77854997 | 0.23157535 | 0.3531274 | 4.30094072 | 0.71734298 | 1.60639063 | 0.68258477 |

FIG. 16O

| EMX 18 | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C3 | 0.023 | 0.008 | 0.032 | 0.044 | 0.035 | 0.016 | 0.03 | 0.016 | 0.016 | 0.018 | 0.02 | 0.017 | 0.01 |
| C9 | 21.333 | 13.606 | 10.333 | 27.294 | 17.216 | 14.646 | 22.315 | 1.297 | 5.485 | 29.094 | 14.566 | 21.847 | 13.66 |
| C10 | 20.865 | 11.831 | 5.528 | 26.409 | 15.041 | 6.931 | 21.548 | 0.932 | 4.309 | 28.456 | 2.996 | 13.762 | 3.337 |
| C12 | 20.773 | 12.165 | 7.147 | 26.572 | 16.178 | 10.157 | 21.839 | 1.202 | 5.059 | 28.937 | 10.88 | 19.625 | 9.359 |
| C13 | 6.538 | 3.591 | 0.848 | 8.562 | 4.096 | 1.387 | 7.426 | 0.129 | 0.729 | 18.993 | 0.945 | 3.353 | 0.809 |
| C18 | 5.174 | 2.54 | 1.788 | 5.313 | 3.146 | 2.196 | 3.443 | 0.243 | 0.565 | 4.517 | 0.647 | 2.03 | 1.154 |
| | | | | | | | | | | | | | |
| indels (%) | 0.039639 | 5.7886 | 23.1911 | 0.035862 | 7.9573 | 30.2671 | 1.1014 | 1.1121 | 4.6798 | 0.040521 | 29.8821 | 14.2217 | 26.5552 |
| | | | | | | | | | | | | | |
| C3 | 0.02299088 | 0.00753691 | 0.02457885 | 0.04398422 | 0.03221495 | 0.01115726 | 0.02966958 | 0.01582206 | 0.01525123 | 0.01799271 | 0.01402358 | 0.01458231 | 0.00734448 |
| C9 | 21.3245438 | 12.8184031 | 7.93666364 | 27.2842118 | 15.8460712 | 10.2130805 | 22.0692226 | 1.28257606 | 5.22831297 | 29.0822108 | 10.2133733 | 18.7399852 | 10.0325597 |
| C10 | 20.8567293 | 11.1461507 | 4.24599599 | 26.3995292 | 13.8441425 | 4.83331873 | 21.3106703 | 0.92163523 | 4.10734742 | 28.4444693 | 2.10073228 | 11.8048096 | 2.45085298 |
| C12 | 20.7647658 | 11.4608168 | 5.48953208 | 26.5624707 | 14.8906668 | 7.08277065 | 21.5984653 | 1.18863256 | 4.82224892 | 28.9252744 | 7.62882752 | 16.8339914 | 6.87369883 |
| C13 | 6.5354084 | 3.38313137 | 0.65133947 | 8.5589295 | 3.77006899 | 0.96719532 | 7.34421004 | 0.12756539 | 0.69488426 | 18.9853038 | 0.66261416 | 2.8761464 | 0.59416843 |
| C18 | 5.17194908 | 2.39296956 | 1.37334313 | 5.31109465 | 2.89566334 | 1.53133448 | 3.4050788 | 0.2402976 | 0.53855913 | 4.51516967 | 0.45366281 | 1.74129949 | 0.84755299 |

FIG. 161

EMX 17

| | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C3 | 0.016 | 0.014 | 0.044 | 0.012 | 0.018 | 0.012 | 0.013 | 0.016 | 0.03 | 0.014 | 0.011 | 0.016 | 0.005 |
| C9 | 12.742 | 6.895 | 2.862 | 17.142 | 10.77 | 5.941 | 10.177 | 1.471 | 3.395 | 18.719 | 11.13 | 11.103 | 11.493 |
| C10 | 11.901 | 6.427 | 2.199 | 16.385 | 10.277 | 5.064 | 9.741 | 1.393 | 3.216 | 18.206 | 8.1 | 10.086 | 7.747 |
| C12 | 11.548 | 6.014 | 1.916 | 15.933 | 9.872 | 4.041 | 9.468 | 1.287 | 2.986 | 18.492 | 9.847 | 10.751 | 10.523 |
| C13 | 1.993 | 0.768 | 0.252 | 2.696 | 1.357 | 0.599 | 1.155 | 0.083 | 0.285 | 10.532 | 0.971 | 3.674 | 1.082 |
| C18 | 1.457 | 0.613 | 0.361 | 1.471 | 0.987 | 0.773 | 0.667 | 0.043 | 0.245 | 1.978 | 0.729 | 0.545 | 0.621 |
| | | | | | | | | | | | | | |
| indels (%) | 0.017245 | 0.052423 | 1.7787 | 0.025203 | 0.11499 | 2.7876 | 0.14938 | 0.019738 | 0.041079 | 0.04713 | 4.2923 | 0.37931 | 6.7995 |
| | | | | | | | | | | | | | |
| C3 | 0.01599724 | 0.01399266 | 0.04321737 | 0.01199698 | 0.0179793 | 0.01166549 | 0.01298058 | 0.01599684 | 0.02998768 | 0.01399334 | 0.01052785 | 0.01593931 | 0.00466003 |
| C9 | 12.7398026 | 6.89138543 | 2.81109361 | 17.1376797 | 10.7576156 | 5.77538868 | 10.1617976 | 1.47070965 | 3.39360537 | 18.7101777 | 10.652267 | 11.0608852 | 10.7115335 |
| C10 | 11.8989477 | 6.42363077 | 2.15988639 | 16.3808705 | 10.2651825 | 4.92283594 | 9.72644889 | 1.39272505 | 3.2146789 | 18.1974195 | 7.7523237 | 10.0477428 | 7.22024274 |
| C12 | 11.5460085 | 6.01084728 | 1.88192011 | 15.9289844 | 9.86064819 | 3.92835308 | 9.4538567 | 1.28674597 | 2.98477338 | 18.4832847 | 9.42433722 | 10.7102204 | 9.80748862 |
| C13 | 1.99265631 | 0.76759739 | 0.24751768 | 2.69532053 | 1.35543959 | 0.58230228 | 1.15327466 | 0.082983362 | 0.284882921 | 10.5270363 | 0.92932177 | 3.66006415 | 1.00842941 |
| C18 | 1.45674874 | 0.61267865 | 0.35457889 | 1.47062926 | 0.98585505 | 0.75145185 | 0.66600364 | 0.042991151 | 0.244899936 | 1.97706777 | 0.69770913 | 0.54293276 | 0.57877511 |

FIG. 162

Hek2 23

| | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C1 | 0.042 | 0.021 | 0 | 0.039 | 0.084 | | 0.045 | 0.07 | 0.04 | 0.045 | 0.056 | 0.057 | 0 |
| C4 | 0.016 | 0.018 | 0 | 0.023 | 0.013 | | 0.027 | 0.022 | 0.016 | 0.035 | 0.008 | 0.016 | 0 |
| C5 | 0.031 | 0.018 | 0 | 0.037 | 0.052 | | 0.048 | 0.021 | 0.044 | 0.047 | 0.157 | 0.017 | 0 |
| C6 | 0.064 | 0.045 | 0 | 0.064 | 0.02 | | 0.077 | 0.068 | 0.051 | 0.078 | 0.032 | 0.08 | 0 |
| C8 | 12.758 | 2.444 | 0 | 19.198 | 3.66 | | 14.134 | 0.423 | 2.22 | 22.158 | 0.977 | 7.763 | 0 |
| C12 | 1.418 | 0.291 | 0 | 2.281 | 0.446 | | 2.163 | 0.101 | 0.21 | 6.745 | 0.235 | 0.809 | 0 |
| C13 | 3.282 | 0.603 | 0 | 5.021 | 1.121 | | 5.713 | 0.042 | 0.308 | 8.933 | 0.599 | 0.921 | 0 |
| C14 | 2.898 | 0.641 | 0 | 4.719 | 1.38 | | 5.614 | 0.096 | 0.38 | 8.268 | 1.066 | 0.746 | 0 |
| | | | | | | | | | | | | | |
| indels (%) | 0.052343 | 11.0664 | | 0.041898 | | | 2.2549 | 6.3138 | 13.9681 | 0.085777 | 59.2508 | 11.3052 | |
| | | | | | | | | | | | | | |
| C1 | 0.0419780 | 0.01867606 | 0 | 0.03898366 | 0.084 | 0 | 0.0439853 | 0.06558034 | 0.03441276 | 0.0449614 | 0.02281955 | 0.05055604 | 0 |
| C4 | 0.01599163 | 0.01600805 | 0 | 0.02299036 | 0.013 | 0 | 0.02639118 | 0.02061096 | 0.0137651 | 0.03496998 | 0.00325994 | 0.01419117 | 0 |
| C5 | 0.03098377 | 0.01600805 | 0 | 0.0369845 | 0.052 | 0 | 0.04691765 | 0.0196741 | 0.03785404 | 0.04695968 | 0.06397624 | 0.01507812 | 0 |
| C6 | 0.0639665 | 0.04002012 | 0 | 0.06397319 | 0.02 | 0 | 0.07526373 | 0.06370662 | 0.04387627 | 0.07793309 | 0.01303974 | 0.07095584 | 0 |
| C8 | 12.7513221 | 2.17353718 | 0 | 19.1899564 | 3.66 | 0 | 13.8152924 | 0.39629263 | 1.90990818 | 22.13899935 | 0.39811968 | 6.88537732 | 0 |
| C12 | 1.41725778 | 0.25879678 | 0 | 2.28004431 | 0.446 | 0 | 2.11422651 | 0.09462306 | 0.180666699 | 6.73921434 | 0.09576062 | 0.71754093 | 0 |
| C13 | 3.2802821 | 0.53626961 | 0 | 5.0188963 | 1.121 | 0 | 5.58417756 | 0.0393482 | 0.26497825 | 8.92533754 | 0.24408771 | 0.81687911 | 0 |
| C14 | 2.8964831 | 0.57006438 | 0 | 4.71702283 | 1.38 | 0 | 5.48740991 | 0.08993875 | 0.32692122 | 8.26090796 | 0.43438647 | 0.66166321 | 0 |

FIG. 163

Hek2 2O

| | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C1 | 0.024 | 0.051 | 0 | 0.036 | 0.116 | 0.126 | 0.035 | 0.022 | 0.042 | 0.032 | 0.02 | 0.133 | 0 |
| C4 | 0.054 | 0.023 | 0 | 0.026 | 0.011 | 0.01 | 0.019 | 0.019 | 0.011 | 0.025 | 0.016 | 0.016 | 0 |
| C5 | 0.033 | 0.017 | 0 | 0.051 | 0.054 | 0.048 | 0.046 | 0.02 | 0.029 | 0.035 | 0.075 | 0.043 | 0 |
| C6 | 0.096 | 0.083 | 0 | 0.058 | 0.032 | 0.022 | 0.055 | 0.016 | 0.047 | 0.139 | 0.166 | 0.083 | 0 |
| C8 | 19.339 | 9.265 | 0 | 23.342 | 13.199 | 1.173 | 17.974 | 3.225 | 7.353 | 32.768 | 2.835 | 20.891 | 0 |
| C12 | 1.402 | 0.551 | 0 | 1.491 | 1.036 | 0.713 | 1.68 | 0.188 | 0.471 | 8.549 | 0.3 | 2.967 | 0 |
| C13 | 2.377 | 1.409 | 0 | 2.974 | 2.174 | 2.814 | 3.043 | 0.356 | 0.895 | 10.654 | 1.81 | 3.81 | 0 |
| C14 | 2.129 | 1.545 | 0 | 2.604 | 2.523 | 5.582 | 3.076 | 0.316 | 0.955 | 8.964 | 4.97 | 3.086 | 0 |
| indels (%) | 0.10237 | 3.2815 | 24.3902 | 0.10375 | 4.3674 | 66.4779 | 1.8097 | 1.6132 | 3.0719 | 0.093678 | 63.4082 | 5.4543 | |
| C1 | 0.02397543 | 0.04932644 | 0 | 0.03596265 | 0.11093382 | 0.04223785 | 0.03436661 | 0.0216451 | 0.0407098 | 0.03197002 | 0.00731836 | 0.12574578 | 0 |
| C4 | 0.05394472 | 0.02224526 | 0 | 0.02597303 | 0.01051959 | 0.00355221 | 0.01865616 | 0.01869349 | 0.01066209 | 0.02497658 | 0.00585469 | 0.01512731 | 0 |
| C5 | 0.03296622 | 0.01644215 | 0 | 0.05094709 | 0.0516416 | 0.01609061 | 0.04516754 | 0.01967736 | 0.02810915 | 0.03496721 | 0.02744385 | 0.04065465 | 0 |
| C6 | 0.09590172 | 0.08027636 | 0 | 0.05793983 | 0.03060243 | 0.00737486 | 0.05400467 | 0.01574189 | 0.04555621 | 0.13886979 | 0.06074239 | 0.07847293 | 0 |
| C8 | 19.3192027 | 8.96096903 | 0 | 23.3177827 | 12.6225469 | 0.39321423 | 17.6487245 | 3.1729743 | 7.12712319 | 32.7373036 | 1.03737753 | 19.7515422 | 0 |
| C12 | 1.40056477 | 0.53291894 | 0 | 1.48945309 | 0.99075374 | 0.23901257 | 1.64959704 | 0.18496718 | 0.45653135 | 8.54099147 | 0.10977754 | 2.80517092 | 0 |
| C13 | 2.37456667 | 1.36276367 | 0 | 2.97091448 | 2.07905272 | 0.94331189 | 2.98793083 | 0.35025701 | 0.86750651 | 10.6440195 | 0.66231158 | 3.60219117 | 0 |
| C14 | 2.12682054 | 1.49430083 | 0 | 2.60129835 | 2.41281105 | 1.87120362 | 3.02033363 | 0.31090229 | 0.92566336 | 8.95560271 | 1.81861246 | 2.9176803 | 0 |

FIG. 16A

Hek2 19

| | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C1 | 0.072 | 0.031 | 0 | 0.039 | 0.062 | 0.406 | 0.023 | 0.019 | 0.025 | 0.06 | 0.224 | 0.04 | 0 |
| C4 | 0.034 | 0.019 | 0 | 0.021 | 0.06 | 0.018 | 0.039 | 0.033 | 0.025 | 0.012 | 0.009 | 0.008 | 0 |
| C5 | 0.03 | 0.037 | 0 | 0.044 | 0.045 | 0.027 | 0.018 | 0.031 | 0.033 | 0.024 | 0.021 | 0.012 | 0 |
| C6 | 0.053 | 0.066 | 0 | 0.042 | 0.071 | 0.164 | 0.033 | 0.031 | 0.046 | 0.098 | 0.117 | 0.034 | 0 |
| C8 | 21.611 | 11.001 | 0 | 25.556 | 18.67 | 6.38 | 18.944 | 4.272 | 10.143 | 33.441 | 15.227 | 25.017 | 0 |
| C12 | 1.049 | 0.704 | 0 | 1.345 | 1.022 | 1.548 | 1.154 | 0.195 | 0.489 | 6.54 | 1.177 | 6.539 | 0 |
| C13 | 1.914 | 1.39 | 0 | 2.629 | 1.819 | 5.23 | 2.301 | 0.253 | 0.881 | 8.065 | 1.823 | 7.452 | 0 |
| C14 | 1.545 | 1.212 | 0 | 2.238 | 1.761 | 9.623 | 1.98 | 0.151 | 0.975 | 6.517 | 4.174 | 6.365 | 0 |
| | | | | | | | | | | | | | |
| indels (%) | 0.056704 | 0.17936 | | 0.04541 | 0.43984 | 50.2032 | 0.61981 | 0.18691 | 0.22381 | 0.14694 | 45.816 | 0.52493 | |
| | | | | | | | | | | | | | |
| C1 | 0.07195917 | 0.0309444 | 0 | 0.03898229 | 0.0617273 | 0.20217501 | 0.02285744 | 0.01896449 | 0.02494405 | 0.05991184 | 0.12137216 | 0.03979003 | 0 |
| C4 | 0.03398072 | 0.01896592 | 0 | 0.02099046 | 0.0597361 | 0.00896342 | 0.03875827 | 0.03293832 | 0.02494405 | 0.01198237 | 0.00487656 | 0.00795801 | 0 |
| C5 | 0.02998299 | 0.03693364 | 0 | 0.04398002 | 0.04480207 | 0.01344514 | 0.01788843 | 0.03094206 | 0.03292614 | 0.02396473 | 0.01137864 | 0.01193701 | 0 |
| C6 | 0.05296995 | 0.06588162 | 0 | 0.04198093 | 0.07068771 | 0.08166675 | 0.03279546 | 0.03094206 | 0.04589705 | 0.097856 | 0.06339528 | 0.03382152 | 0 |
| C8 | 21.5987457 | 10.9812686 | 0 | 25.5443395 | 18.5878819 | 3.17703584 | 18.8265832 | 4.26402152 | 10.120299 | 33.3918618 | 8.25059768 | 24.8856783 | 0 |
| C12 | 1.04840518 | 0.70273731 | 0 | 1.34438924 | 1.01750484 | 0.77085446 | 1.14684739 | 0.19463553 | 0.48790557 | 6.53039012 | 0.63774568 | 6.50467483 | 0 |
| C13 | 1.91291469 | 1.3875069 | 0 | 2.62780617 | 1.81099931 | 2.60437264 | 2.28673817 | 0.25252712 | 0.87902823 | 8.05314929 | 0.98777432 | 7.41288222 | 0 |
| C14 | 1.54412392 | 1.20982616 | 0 | 2.23698372 | 1.75325442 | 4.79194606 | 1.96772776 | 0.15071777 | 0.97281785 | 6.50742392 | 2.26164016 | 6.33158821 | 0 |

FIG. 165

HeK2 18

| | 10_D | 10_N | 10_A | 11_D | 11_N | 11_A | 13_D | 13_N | 13_A | 14_D | 14_A | 15_N | 15_A |
|---|---|---|---|---|---|---|---|---|---|---|---|---|---|
| C1 | 0.037 | 0.027 | 0 | 0.035 | 0.041 | 0.315 | 0.039 | 0.034 | 0.034 | 0.028 | 0.125 | 0.074 | 0 |
| C4 | 0.014 | 0.016 | 0 | 0.007 | 0.018 | 0.017 | 0.018 | 0.038 | 0.019 | 0.014 | 0.021 | 0.035 | 0 |
| C5 | 0.052 | 0.018 | 0 | 0.051 | 0.034 | 0.045 | 0.033 | 0.039 | 0.022 | 0.014 | 0.088 | 0.035 | 0 |
| C6 | 0.056 | 0.035 | 0 | 0.032 | 0.08 | 0.047 | 0.082 | 0.051 | 0.07 | 0.081 | 0.208 | 0.107 | 0 |
| C8 | 16.035 | 10.427 | 0 | 25.298 | 19.509 | 14.808 | 15.991 | 5.043 | 10.926 | 33.064 | 28.458 | 29.702 | 0 |
| C12 | 0.571 | 0.503 | 0 | 0.802 | 1.161 | 1.138 | 0.513 | 0.228 | 0.317 | 5.485 | 1.471 | 7.611 | 0 |
| C13 | 1.12 | 0.903 | 0 | 1.607 | 1.869 | 2.299 | 0.803 | 0.315 | 0.709 | 5.902 | 1.741 | 8.752 | 0 |
| C14 | 0.877 | 0.819 | 0 | 1.132 | 1.609 | 3.468 | 0.751 | 0.375 | 0.636 | 4.806 | 2.316 | 7.414 | 0 |
| indels (%) | 0.076858 | 0.17892 | | 0.048785 | 0.13947 | 11.5608 | 0.14868 | 0.1177 | 0.076621 | 0.23744 | 9.8678 | 0.50485 | |
| C1 | 0.03697156 | 0.02695169 | 0 | 0.03498293 | 0.04094282 | 0.27858348 | 0.03894201 | 0.03395998 | 0.03397395 | 0.02793352 | 0.112566525 | 0.07362641 | 0 |
| C4 | 0.01398924 | 0.01597137 | 0 | 0.00699659 | 0.0179749 | 0.01503466 | 0.01797324 | 0.03795527 | 0.01898544 | 0.01396676 | 0.01892775 | 0.0348233 | 0 |
| C5 | 0.05196003 | 0.01796779 | 0 | 0.05097512 | 0.03395258 | 0.03979764 | 0.03295094 | 0.0389541 | 0.02198314 | 0.01396676 | 0.07931634 | 0.0348233 | 0 |
| C6 | 0.05595696 | 0.03493738 | 0 | 0.03198439 | 0.07988842 | 0.04155642 | 0.08187808 | 0.05093997 | 0.06994637 | 0.08080767 | 0.18747498 | 0.10645981 | 0 |
| C8 | 16.0226758 | 10.408344 | 0 | 25.28565584 | 19.48179080 | 13.09660767 | 15.9672246 | 5.03706439 | 10.9176284 | 32.9854928 | 25.6498215 | 29.5520495 | 0 |
| C12 | 0.57056114 | 0.50210003 | 0 | 0.80160874 | 1.159380075 | 1.00643810 | 0.512237277 | 0.227731640 | 0.316757110 | 5.47197642 | 1.325844660 | 7.52757587 | 0 |
| C13 | 1.11913919 | 0.90138435 | 0 | 1.60621603 | 1.86639331 | 2.03321721 | 0.80180610 | 0.31462925 | 0.708456760 | 5.88798629 | 1.56920160 | 8.707815530 | 0 |
| C14 | 0.87632596 | 0.81753465 | 0 | 1.13144775 | 1.60675593 | 3.06707146 | 0.74988341 | 0.37455863 | 0.63551269 | 4.79458863 | 2.08746175 | 7.37657042 | 0 |

FIG. 166

NUCLEOBASE EDITORS COMPRISING NUCLEIC ACID PROGRAMMABLE DNA BINDING PROTEINS

RELATED APPLICATIONS

This application claims priority under 35 U.S.C. § 119(e) to U.S. provisional patent applications, U.S. Ser. No. 62/551,951, filed Aug. 30, 2017; U.S. Ser. No. 62/511,934, filed May 26, 2017; U.S. Ser. No. 62/490,587, filed Apr. 26, 2017; and U.S. Ser. No. 62/475,830, filed Mar. 23, 2017, each of which are incorporated herein by reference.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on Oct. 7, 2020, is named H082470257US04-SEQ-CHB and is 1,336,633 bytes in size.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases.[1] An ideal nucleic acid editing technology possesses three characteristics: (1) high efficiency of installing the desired modification; (2) minimal off-target activity; and (3) the ability to be programmed to edit precisely any site in a given nucleic acid, e.g., any site within the human genome.[2] Current genome engineering tools, including engineered zinc finger nucleases (ZFNs),[3] transcription activator like effector nucleases (TALENs),[4] and most recently, the RNA-guided DNA endonuclease Cas9,[5] effect sequence-specific DNA cleavage in a genome. This programmable cleavage can result in mutation of the DNA at the cleavage site via non-homologous end joining (NHEJ) or replacement of the DNA surrounding the cleavage site via homology-directed repair (HDR).[6,7]

One drawback to the current technologies is that both NHEJ and HDR are stochastic processes that typically result in modest gene editing efficiencies as well as unwanted gene alterations that can compete with the desired alteration.[8] Since many genetic diseases in principle can be treated by effecting a specific nucleotide change at a specific location in the genome (for example, a C to T change in a specific codon of a gene associated with a disease),[9] the development of a programmable way to achieve such precision gene editing would represent both a powerful new research tool, as well as a potential new approach to gene editing-based human therapeutics.

SUMMARY OF THE INVENTION

Nucleic acid programmable DNA binding proteins (napDNAbp), such as the clustered regularly interspaced short palindromic repeat (CRISPR) system is a recently discovered prokaryotic adaptive immune system[10] that has been modified to enable robust and general genome engineering in a variety of organisms and cell lines.[11] CRISPR-Cas (CRISPR associated) systems are protein-RNA complexes that use an RNA molecule (sgRNA) as a guide to localize the complex to a target DNA sequence via base-pairing.[12] In the natural systems, a Cas protein then acts as an endonuclease to cleave the targeted DNA sequence.[13] The target DNA sequence must be both complementary to the sgRNA, and also contain a "protospacer-adjacent motif" (PAM) at the 3'-end of the complementary region in order for the system to function.[14]

Among the known Cas proteins, *S. pyogenes* Cas9 has been mostly widely used as a tool for genome engineering.[15] This Cas9 protein is a large, multi-domain protein containing two distinct nuclease domains. Point mutations can be introduced into Cas9 to abolish nuclease activity, resulting in a dead Cas9 (dCas9) that still retains its ability to bind DNA in a sgRNA-programmed manner.[16] In principle, when fused to another protein or domain, dCas9 can target that protein or domain to virtually any DNA sequence simply by co-expression with an appropriate sgRNA.

The potential of the dCas9 complex for genome engineering purposes is immense. Its unique ability to bring proteins to specific sites in a genome programmed by the sgRNA in theory can be developed into a variety of site-specific genome engineering tools beyond nucleases, including deaminases (e.g., cytidine deamianses), transcriptional activators, transcriptional repressors, histone-modifying proteins, integrases, and recombinases.[11] Some of these potential applications have recently been implemented through dCas9 fusions with transcriptional activators to afford RNA-guided transcriptional activators,[17,18] transcriptional repressors, 16,19,20 and chromatin modification enzymes.[21] Simple co-expression of these fusions with a variety of sgRNAs results in specific expression of the target genes. These seminal studies have paved the way for the design and construction of readily programmable sequence-specific effectors for the precise manipulation of genomes.

Some aspects of the disclosure are based on the recognition that certain configurations of a nucleic acid programmable DNA binding protein (napDNAbp), for example CasX, CasY, Cpf1, C2c1, C2c2, C2c3, or Argonaute protein, and a cytidine deaminase domain fused by a linker are useful for efficiently deaminating target cytidine residues. Other aspects of this disclosure relate to the recognition that a nucleobase editing fusion protein with a cytidine deaminase domain fused to the N-terminus of a napDNAbp via a linker was capable of efficiently deaminating target nucleic acids in a double stranded DNA target molecule. See, for example, Examples 3 and 4 below, which demonstrate that the fusion proteins, which are also referred to herein as base editors, generate less indels and more efficiently deaminate target nucleic acids than other base editors, such as base editors without a UGI domain. Other aspects of this disclosure relate to the recognition that a nucleobase editing fusion protein with a cytidine deaminase domain fused to the N-terminus of napDNAbp via a linker perform base editing with higher efficiency and greatly improved product purity when the fusion protein is comprised of more than one UGI domain. See, for example, Example 17, which demonstrates that a fusion protein (e.g., base editor) comprising two UGI domains generates less indels and more efficiently deaminates target nucleic acids than other base editors, such as those comprising one UGI domain.

In some embodiments, the fusion protein comprises: (i) a nucleic acid programmable DNA binding protein (napDNAbp); (ii) a cytidine deaminase domain; and (iii) a uracil glycosylase inhibitor (UGI) domain, where the napDNAbp is a CasX, CasY, Cpf1, C2c1, C2c2, C2c3, or Argonaute protein. In some embodiments, the nucleic acid programmable DNA binding protein (napDNAbp) is a CasX protein. In some embodiments, the CasX protein comprises an amino acid sequence that is at least 90% identical to SEQ ID NO: 29 or 30. In some embodiments, the CasX protein comprises the amino acid sequence of SEQ ID NO: 29 or 30.

In some embodiments, the fusion protein comprises: (i) a nucleic acid programmable DNA binding protein (napDNAbp); (ii) a cytidine deaminase domain; (iii) a first uracil glycosylase inhibitor (UGI) domain; and (iv) a second uracil glycosylase inhibitor (UGI) domain, wherein the napDNAbp is a Cas9, dCas9, or Cas9 nickase protein. In some embodiments, the napDNAbp is a dCas9 protein. In some embodiments, the napDNAbp is a CasX, CasY, Cpf1, C2c1, C2c2, C2c3, or Argonaute protein. In some embodiments, the dCas9 protein is a *S. pyogenes* dCas9 (SpCas9d). In some embodiments, the dCas9 protein is a *S. pyogenes* dCas9 harboring a D10A mutation. In some embodiments, the dCas9 protein comprises an amino acid sequence that is at least 90% identical to SEQ ID NO: 6 or 7. In some embodiments, the dCas9 protein comprises the amino acid sequence of SEQ ID NO: 6 or 7. In some embodiments, the dCas9 protein is a *S. aureus* dCas9 (SaCas9d). In some embodiments, the dCas9 protein is a *S. aureus* dCas9 harboring a D10A mutation. In some embodiments, the dCas9 protein comprises an amino acid sequence that is at least 90% identical to SEQ ID NO: 33-36. In some embodiments, the dCas9 protein comprises the amino acid sequence of SEQ ID NO: 33-36.

In some embodiments, the nucleic acid programmable DNA binding protein (napDNAbp) is a CasY protein. In some embodiments, the CasY protein comprises an amino acid sequence that is at least 90% identical to SEQ ID NO: 31. In some embodiments, the CasY protein comprises the amino acid sequence of SEQ ID NO: 31.

In some embodiments, the nucleic acid programmable DNA binding protein (napDNAbp) is a Cpf1 or Cpf1 mutant protein. In some embodiments, the Cpf1 or Cpf1 mutant protein comprises an amino acid sequence that is at least 90% identical to any one of SEQ ID NOs: 9-24. In some embodiments, the Cpf1 or Cpf1 mutant protein comprises the amino acid sequence of any one of SEQ ID NOs: 9-24.

In some embodiments, the nucleic acid programmable DNA binding protein (napDNAbp) is a C2c1 protein. In some embodiments, the C2c1 protein comprises an amino acid sequence that is at least 90% identical to SEQ ID NO: 26. In some embodiments, the C2c1 protein comprises the amino acid sequence of SEQ ID NO: 26.

In some embodiments, the nucleic acid programmable DNA binding protein (napDNAbp) is a C2c2 protein. In some embodiments, the C2c2 protein comprises an amino acid sequence that is at least 90% identical to SEQ ID NO: 27. In some embodiments, the C2c2 protein comprises the amino acid sequence of SEQ ID NO: 27.

In some embodiments, the nucleic acid programmable DNA binding protein (napDNAbp) is a C2c3 protein. In some embodiments, the C2c3 protein comprises an amino acid sequence that is at least 90% identical to SEQ ID NO: 28. In some embodiments, the C2c3 protein comprises the amino acid sequence of SEQ ID NO: 28.

In some embodiments, the nucleic acid programmable DNA binding protein (napDNAbp) is an Argonaute protein. In some embodiments, the Argonaute protein comprises an amino acid sequence that is at least 90% identical to SEQ ID NO: 25. In some embodiments, the Argonaute protein comprises the amino acid sequence of SEQ ID NO: 25.

Some aspects of the disclosure are based on the recognition that fusion proteins provided herein are capable of generating one or more mutations (e.g., a C to T mutation) without generating a large proportion of indels. In some embodiments, any of the fusion proteins (e.g., base editing proteins) provided herein generate less than 10% indels. In some embodiments, any of the fusion proteins (e.g., base editing proteins) provided herein generate less than 10%, 9%, 8%, 7%, 6%, 5.5%, 5%, 4.5%, 4%, 3.5%, 3%, 2.5%, 2%, 1.5%, 1%, 0.5%, or 0.1% indels.

In some embodiments, the fusion protein comprises a napDNAbp and an apolipoprotein B mRNA-editing complex 1 (APOBEC1) deaminase domain, where the deaminase domain is fused to the N-terminus of the napDNAbp domain via a linker comprising the amino acid sequence SGSETPGTSESATPES (SEQ ID NO: 604). In some embodiments, the napDNAbp comprises the amino acid sequence of any of the napDNAbp provided herein. In some embodiments, the deaminase is rat APOBEC1 (SEQ ID NO: 76). In some embodiments, the deaminase is human APOBEC1 (SEQ ID NO: 74). In some embodiments, the deaminase is pmCDA1 (SEQ ID NO: 81). In some embodiments, the deaminase is human APOBEC3G (SEQ ID NO: 60). In some embodiments, the deaminase is a human APOBEC3G variant of any one of (SEQ ID NOs: 82-84). In some embodiments, the fusion protein comprises a napDNAbp and an apolipoprotein B mRNA-editing complex 1 catalytic polypeptide-like 3G (APOBEC3G) deaminase domain, wherein the deaminase domain is fused to the N-terminus of the napDNAbp domain via a linker of any length or composition (e.g., an amino acid sequence, a peptide, a polymer, or a bond). In some embodiments, the linker comprises the amino acid sequence SGSETPGTSESATPES (SEQ ID NO: 604). In some embodiments, the linker comprises the amino acid sequence SGGSSGGSSGSETPGTSESATPESSGGSSGGS (SEQ ID NO: 605).

In some embodiments, the fusion protein comprises a napDNAbp and a cytidine deaminase 1 (CDA1) deaminase domain, wherein the deaminase domain is fused to the N-terminus of the napDNAbp domain via a linker comprising the amino acid sequence SGSETPGTSESATPES (SEQ ID NO: 604). In some embodiments, the linker comprises the amino acid sequence SGGSSGGSSGSETPGTSESATPESSGGSSGGS (SEQ ID NO: 605). In some embodiments, the napDNAbp comprises the amino acid sequence of any of the napDNAbps provided herein.

In some embodiments, the fusion protein comprises a napDNAbp and an activation-induced cytidine deaminase (AID) deaminase domain, where the deaminase domain is fused to the N-terminus of the napDNAbp domain via a linker comprising the amino acid sequence SGSETPGTSESATPES (SEQ ID NO: 604). In some embodiments, the linker comprises the amino acid sequence SGGSSGGSSGSETPGTSESATPESSGGSSGGS (SEQ ID NO: 605). In some embodiments, the napDNAbp comprises the amino acid sequence of any of the napDNAbps provided herein.

Some aspects of the disclosure are based on the recognition that certain configurations of a napDNAbp, and a cytidine deaminase domain fused by a linker are useful for efficiently deaminating target cytidine residues. Other aspects of this disclosure relate to the recognition that a nucleobase editing fusion protein with an apolipoprotein B mRNA-editing complex 1 (APOBEC1) deaminase domain fused to the N-terminus of a napDNAbp via a linker comprising the amino acid sequence SGSETPGTSESATPES (SEQ ID NO: 604) was capable of efficiently deaminating target nucleic acids in a double stranded DNA target molecule. In some embodiments, the fusion protein comprises a napDNAbp domain and an apolipoprotein B mRNA-editing complex 1 (APOBEC1) deaminase domain, where the deaminase domain is fused to the N-terminus of the napD- NAbp via a linker comprising the amino acid sequence SGSETPGTSESATPES (SEQ ID NO: 604).

Some aspects of this disclosure provide strategies, systems, reagents, methods, and kits that are useful for the targeted editing of nucleic acids, including editing a single site within a subject's genome, e.g., a human's genome. In some embodiments, fusion proteins of napDNAbp (e.g., CasX, CasY, Cpf1, C2c1, C2c2, C2c3, or Argonaute protein) and deaminases or deaminase domains, are provided. In some embodiments, methods for targeted nucleic acid editing are provided. In some embodiments, reagents and kits for the generation of targeted nucleic acid editing proteins, e.g., fusion proteins of napDNAbp and deaminases or deaminase domains, are provided.

Some aspects of this disclosure provide fusion proteins comprising a napDNAbp as provided herein that is fused to a second protein (e.g., an enzymatic domain such as a cytidine deaminase domain), thus forming a fusion protein. In some embodiments, the second protein comprises an enzymatic domain, or a binding domain. In some embodiments, the enzymatic domain is a nuclease, a nickase, a recombinase, a deaminase, a methyltransferase, a methylase, an acetylase, an acetyltransferase, a transcriptional activator, or a transcriptional repressor domain. In some embodiments, the enzymatic domain is a nucleic acid editing domain. In some embodiments, the nucleic acid editing domain is a deaminase domain. In some embodiments, the deaminase is a cytosine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). It should be appreciated that the deaminase may be from any suitable organism (e.g., a human or a rat). In some embodiments, the deaminase is from a human, chimpanzee, gorilla, monkey, cow, dog, rat, or mouse. In some embodiments, the deaminase is rat APOBEC1 (SEQ ID NO: 76). In some embodiments, the deaminase is human APOBEC1 (SEQ ID NO: 74). In some embodiments, the deaminase is pmCDA1.

Some aspects of this disclosure provide fusion proteins comprising: (i) a CasX, CasY, Cpf1, C2c1, C2c2, C2c3, or Argonaute protein domain comprising the amino acid sequence of SEQ ID NO: 32; and (ii) an apolipoprotein B mRNA-editing complex 1 (APOBEC1) deaminase domain, wherein the deaminase domain is fused to the N-terminus of the napDNAbp via a linker comprising the amino acid sequence of SGSETPGTSESATPES (SEQ ID NO: 604). In some embodiments, the deaminase is rat APOBEC1 (SEQ ID NO: 76). In some embodiments, the deaminase is human APOBEC1 (SEQ ID NO: 74). In some embodiments, the fusion protein comprises the amino acid sequence of SEQ ID NO: 591. In some embodiments, the fusion protein comprises the amino acid sequence of SEQ ID NO: 5737. In some embodiments, the deaminase is pmCDA1 (SEQ ID NO: 81). In some embodiments, the deaminase is human APOBEC3G (SEQ ID NO: 60). In some embodiments, the deaminase is a human APOBEC3G variant of any one of SEQ ID NOs: 82-84.

Other aspects of this disclosure relate to the recognition that fusion proteins comprising a deaminase domain, a napDNAbp domain and a uracil glycosylase inhibitor (UGI) domain demonstrate improved efficiency for deaminating target nucleotides in a nucleic acid molecule. Without wishing to be bound by any particular theory, cellular DNA-repair response to the presence of U:G heteroduplex DNA may be responsible for a decrease in nucleobase editing efficiency in cells. Uracil DNA glycosylase (UDG) catalyzes removal of U from DNA in cells, which may initiate base excision repair, with reversion of the U:G pair to a C:G pair as the most common outcome. As demonstrated herein, Uracil DNA Glycosylase Inhibitor (UGI) may inhibit human UDG activity. Without wishing to be bound by any particular theory, base excision repair may be inhibited by molecules that bind the single strand, block the edited base, inhibit UGI, inhibit base excision repair, protect the edited base, and/or promote "fixing" of the non-edited strand, etc. Thus, this disclosure contemplates fusion proteins comprising a napDNAbp-cytidine deaminase domain that is fused to a UGI domain.

Further aspects of this disclosure relate to the recognition that fusion proteins comprising a deaminase domain, a napDNAbp domain, and more than one uracil glycosylase inhibitor (UGI) domain (e.g., one, two, three, four, five, or more UGI domains) demonstrate improved efficiency for deaminating target nucleotides in a nucleic acid molecule and/or improved nucleic acid product purity. Without wishing to be bound by any particular theory, the addition of a second UGI domain may substantially decrease the access of UDG to the G:U base editing intermediate, thereby improving the efficiency of the base editing.

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating insertions or deletions (i.e., indels) in the nucleic acid. In certain embodiments, any of the base editors provided herein are capable of generating a greater proportion of intended modifications (e.g., point mutations or deaminations) versus indels.

In certain embodiments, any of the base editors provided herein are capable of generating a certain percentage of desired mutations. In some embodiments, the desired mutation is a C to T mutation. In some embodiments, the desired mutation is a C to A mutation. In some embodiments, the desired mutation is a C to G mutation. In some embodiments, any of the base editors provided herein are capable of generating at least 1% of desired mutations. In some embodiments, any of the base editors provided herein are capable of generating at least 1%, 2%, 3%, 4%, 5%, 10%, 15%, 20%, 25%, 30%, 40%, 45%, 50%, 60%, 70%, 80%, 90%, 95%, or 99% of desired mutations.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations.

In some embodiments, the deaminase domain of the fusion protein is fused to the N-terminus of the napDNAbp domain. In some embodiments, the UGI domain is fused to the C-terminus of the napDNAbp domain. In some embodiments, the napDNAbp and the nucleic acid editing domain are fused via a linker. In some embodiments, the napDNAbp domain and the UGI domain are fused via a linker. In some embodiments, a second UGI domain is fused to the C-terminus of a first UGI domain. In some embodiments, the first UGI domain and the second UGI domain are fused via a linker.

In certain embodiments, linkers may be used to link any of the peptides or peptide domains of the invention. The linker may be as simple as a covalent bond, or it may be a polymeric linker many atoms in length. In certain embodiments, the linker is a polpeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker comprises the amino acid sequence $(GGGGS)_n$ (SEQ ID NO: 607), $(G)_n$(SEQ ID NO: 608), $(EAAAK)_n$ (SEQ ID NO: 609), $(GGS)_n$(SEQ ID NO:610), $(SGGS)_n$(SEQ ID NO: 606), SGSETPGTSESATPES (SEQ ID NO: 604), $(XP)_n$ (SEQ ID NO: 611), SGGS$(GGS)_n$ (SEQ ID NO: 612), SGGSSGGSSGSETPGTSESATPESSGGSSGGS (SEQ ID NO: 605), or any combination thereof, wherein n is independently an integer between 1 and 30, and X is any amino acid. In some embodiments, the linker comprises the amino acid sequence $(GGS)_n$(SEQ ID NO: 610), wherein n is 1, 3, or 7. In some embodiments, the linker comprises the amino acid sequence SGGS$(GGS)_n$ (SEQ ID NO: 612), wherein n is 2. In some embodiments, the linker comprises the amino acid sequence SGSETPGTSESATPES (SEQ ID NO: 604). In some embodiments, the linker comprises the amino acid sequence SGGSSGGSSGSETPGTSESATPESSGGSSGGS (SEQ ID NO: 605).

In some embodiments, the fusion protein comprises the structure [nucleic acid editing domain]-[optional linker sequence]-[napDNAbp]-[optional linker sequence]-[UGI]. In some embodiments, the fusion protein comprises the structure [nucleic acid editing domain]-[optional linker sequence]-[UGI]-[optional linker sequence]-[napDNAbp]; [UGI]-[optional linker sequence]-[nucleic acid editing domain]-[optional linker sequence]-[napDNAbp]; [UGI]-[optional linker sequence]-[napDNAbp]-[optional linker sequence]-[nucleic acid editing domain]; [napDNAbp]-[optional linker sequence]-[UGI]-[optional linker sequence]-[nucleic acid editing domain]; [napDNAbp]-[optional linker sequence]-[nucleic acid editing domain]-[optional linker sequence]-[UGI]; or [nucleic acid editing domain]-[optional linker sequence]-[napDNAbp]-[optional linker sequence]-[first UGI]-[optional linker sequence]-[second UGI].

In some embodiments, the nucleic acid editing domain comprises a deaminase. In some embodiments, the deaminase is a cytidine deaminase. In some embodiments, the deaminase is an apolipoprotein B mRNA-editing complex (APOBEC) family deaminase. In some embodiments, the deaminase is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, or an APOBEC4 deaminase. In some embodiments, the deaminase is an activation-induced deaminase (AID). In some embodiments, the deaminase is a cytidine deaminase 1 (CDA1). In some embodiments, the deaminase is a Lamprey CDA1 (pmCDA1) deaminase.

In some embodiments, the deaminase is from a human, chimpanzee, gorilla, monkey, cow, dog, rat, or mouse. In some embodiments, the deaminase is from a human. In some embodiments the deaminase is from a rat. In some embodiments, the deaminase is a rat APOBEC1 deaminase comprising the amino acid sequence set forth in (SEQ ID NO: 76). In some embodiments, the deaminase is a human APOBEC1 deaminase comprising the amino acid sequence set forth in (SEQ ID NO: 74). In some embodiments, the deaminase is pmCDA1 (SEQ ID NO: 81). In some embodiments, the deaminase is human APOBEC3G (SEQ ID NO: 60). In some embodiments, the deaminase is a human APOBEC3G variant of any one of (SEQ ID NOs: 82-84). In some embodiments, the deaminase is at least 80%, at least 85%, at least 90%, at least 92%, at least 95%, at least 96%, at least 97%, at least 98%, at least 99%, or at least 99.5% identical to any one of the amino acid sequences set forth in SEQ ID NOs: 49-84.

In some embodiments, the UGI domain comprises an amino acid sequence that is at least 80%, at least 85%, at least 90%, at least 92%, at least 95%, at least 96%, at least 97%, at least 98%, at least 99%, or at least 99.5% identical to SEQ ID NO: 134. In some embodiments, the UGI domain comprises the amino acid sequence as set forth in SEQ ID NO: 134.

Some aspects of this disclosure provide complexes comprising a napDNAbp fusion protein as provided herein, and a guide RNA bound to the napDNAbp.

Some aspects of this disclosure provide methods of using the napDNAbp, fusion proteins, or complexes provided herein. For example, some aspects of this disclosure provide methods comprising contacting a DNA molecule (a) with a napDNAbp or a fusion protein as provided herein and with a guide RNA, wherein the guide RNA is about 15-100 nucleotides long and comprises a sequence of at least 10 contiguous nucleotides that is complementary to a target sequence; or (b) with a napDNAbp, a napDNAbp fusion protein, or a napDNAbp or napDNAbp complex with a gRNA as provided herein.

Some aspects of this disclosure provide kits comprising a nucleic acid construct, comprising (a) a nucleotide sequence encoding a napDNAbp or a napDNAbp fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding a napDNAbp of a fusion protein as provided herein. Some aspects of this disclosure provide vectors comprising such polynucleotides. In some embodiments, the vector comprises a heterologous promoter driving expression of polynucleotide.

Some aspects of this disclosure provide cells comprising a napDNAbp protein, a fusion protein, a nucleic acid molecule, and/or a vector as provided herein.

It should be appreciated that any of the fusion proteins provided herein that include a Cas9 domain (e.g. Cas9, nCas9, or dCas9) may be replaced with any of the napDNAbp provided herein, for example CasX, CasY, Cpf1, C2c1, C2c2, C2c3, or Argonaute protein.

The description of exemplary embodiments of the reporter systems above is provided for illustration purposes only and not meant to be limiting. Additional reporter systems, e.g., variations of the exemplary systems described in detail above, are also embraced by this disclosure.

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 9 shows in vitro C→T editing efficiencies using His6-rAPOBEC1-XTEN-dCas9.

FIG. 10 shows C→T editing efficiencies in HEK293T cells is greatly enhanced by fusion with UGI.

FIGS. 11A to 11C show NBE1 mediates specific, guide RNA-programmed C to U conversion in vitro. FIG. 11A: Nucleobase editing strategy. DNA with a target C at a locus specified by a guide RNA is bound by dCas9, which mediates the local denaturation of the DNA substrate. Cytidine deamination by a tethered APOBEC1 enzyme converts the target C to U. The resulting G:U heteroduplex can be permanently converted to an A:T base pair following DNA replication or repair. If the U is in the template DNA strand, it will also result in an RNA transcript containing a G to A mutation following transcription. FIG. 11B: Deamination assay showing an activity window of approximately five nucleotides. Following incubation of NBE1-sgRNA complexes with dsDNA substrates at 37° C. for 2 h, the 5' fluorophore-labeled DNA was isolated and incubated with USER enzyme (uracil DNA glycosylase and endonuclease VIII) at 37° C. for 1 h to induce DNA cleavage at the site of any uracils. The resulting DNA was resolved on a denaturing polyacrylamide gel, and any fluorophore-linked strands were visualized. Each lane is labeled according to the position of the target C within the protospacer, or with "-" if no target C is present, counting the base distal from the PAM as position 1. FIG. 11C: Deaminase assay showing the sequence specificity and sgRNA-dependence of NBE1. The DNA substrate with a target C at position 7 was incubated with NBE1 as in FIG. 11B with either the correct sgRNA, a mismatched sgRNA, or no sgRNA. No C to U editing is observed with the mismatched sgRNA or with no sgRNA. The positive control sample contains a DNA sequence with a U synthetically incorporated at position 7.

FIG. 12A: Effect of changing the sequence surrounding the target C on editing efficiency in vitro. The deamination yield of 80% of targeted strands (40% of total sequencing reads from both strands) for $C_7$ in the protospacer sequence 5'-TTATTTCGTGGATTTATTTA-3'(SEQ ID NO: 591) was defined as 1.0, and the relative deamination efficiencies of substrates containing all possible single-base mutations at positions 1-6 and 8-13 are shown. Values and error bars reflect the mean and standard deviation of two or more independent biological replicates performed on different days. FIG. 12B: Positional effect of each NC motif on editing efficiency in vitro. Each NC target motif was varied from positions 1 to 8 within the protospacer as indicated in the sequences shown on the right (the PAM shown in red, the protospacer plus one base 5' to the protospacer are also shown). The percentage of total sequence reads containing T at each of the numbered target C positions following incubation with NBE1 is shown in the graph. Note that the maximum possible deamination yield in vitro is 50% of total sequencing reads (100% of targeted strands). Values and error bars reflect the mean and standard deviation of two or three independent biological replicates performed on different days. FIG. 12B depicts SEQ ID NOs: 619 through 626 from top to bottom, respectively.

FIGS. 13A to 13C show nucleobase editing in human cells. FIG. 13A: Protospacer and PAM sequences of the six mammalian cell genomic loci targeted by nucleobase editors. Target Cs are indicated with subscripted numbers corresponding to their positions within the protospacer. FIG. 13A depicts SEQ ID NOs: 127 through 132 from top to bottom, respectively. FIG. 13B: HEK293T cells were transfected with plasmids expressing NBE1, NBE2, or NBE3 and an appropriate sgRNA. Three days after transfection, genomic DNA was extracted and analyzed by high-throughput DNA sequencing at the six loci. Cellular C to T conversion percentages, defined as the percentage of total DNA sequencing reads with Ts at the target positions indicated, are shown for NBE1, NBE2, and NBE3 at all six genomic loci, and for wt Cas9 with a donor HDR template at three of the six sites (EMX1, HEK293 site 3, and HEK293 site 4). Values and error bars reflect the mean and standard deviation of three independent biological replicates performed on different days. FIG. 13C: Frequency of indel formation, calculated as described in the Methods, is shown following treatment of HEK293T cells with NBE2 and NBE3 for all six genomic loci, or with wt Cas9 and a single-stranded DNA template for HDR at three of the six sites (EMX1, HEK293 site 3, and HEK293 site 4). Values reflect the mean of at least three independent biological replicates performed on different days.

Figures 14A, 14B, 14C:
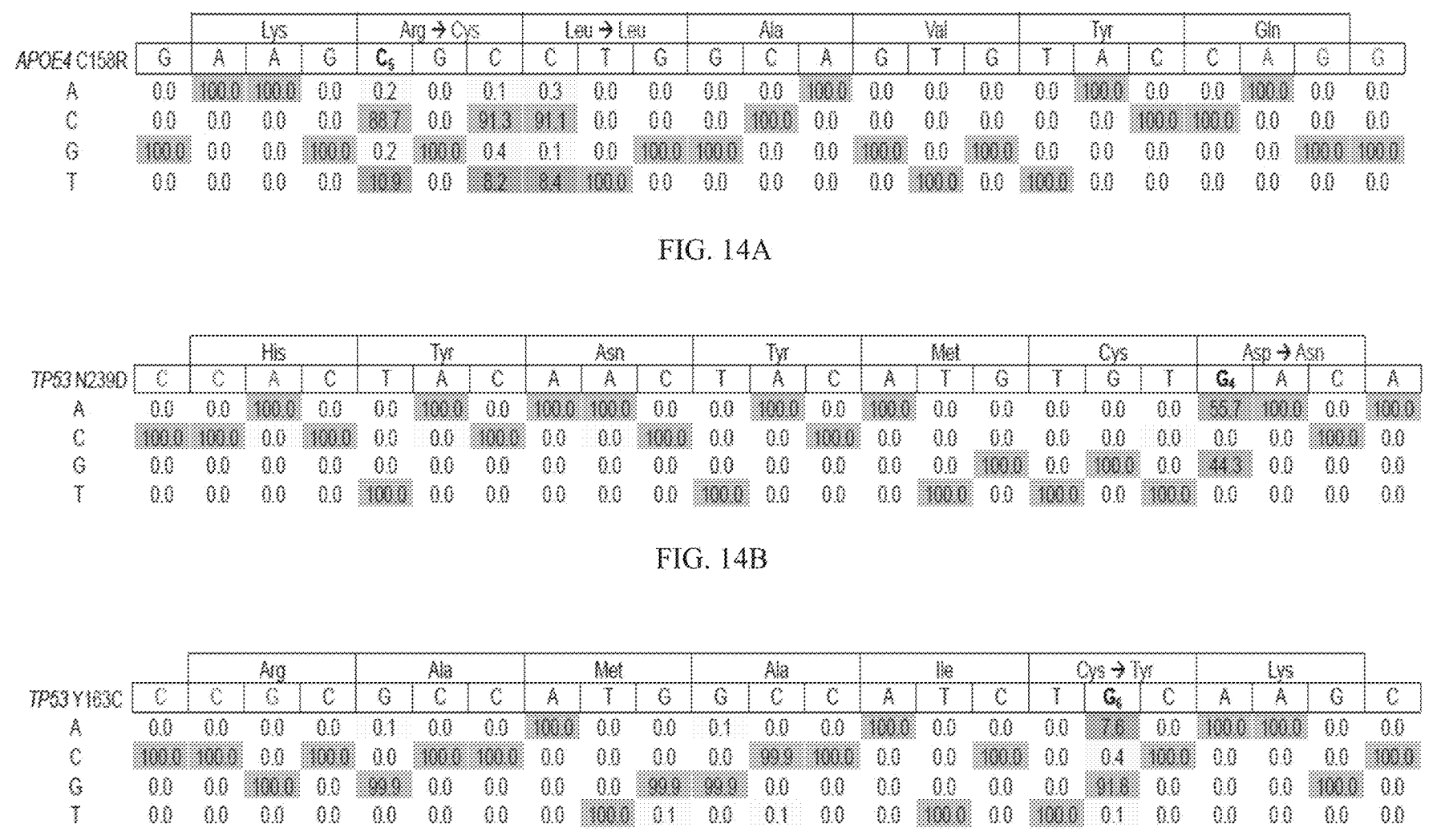

FIGS. 14A to 14C show NBE2- and NBE3-mediated correction of three disease-relevant mutations in mammalian cells. For each site, the sequence of the protospacer is indicated to the right of the name of the mutation, with the PAM and the base responsible for the mutation indicated in bold with a subscripted number corresponding to its position within the protospacer. The amino acid sequence above each disease-associated allele is shown, together with the corrected amino acid sequence following nucleobase editing in red. Underneath each sequence are the percentages of total sequencing reads with the corresponding base. Cells were nucleofected with plasmids encoding NBE2 or NBE3 and an appropriate sgRNA. Two days after nucleofection, genomic DNA was extracted and analyzed by HTS to assess pathogenic mutation correction. FIG. 14A: The Alzheimer's disease-associated APOE4 allele is converted to APOE3' in mouse astrocytes by NBE3 in 11% of total reads (44% of nucleofected astrocytes). Two nearby Cs are also converted to Ts, but with no change to the predicted sequence of the resulting protein (SEQ ID NO: 627). FIG. 14B The cancer-associated p53 N239D mutation is corrected by NBE2 in 11% of treated human lymphoma cells (12% of nucleofected cells) that are heterozygous for the mutation (SEQ ID NO: 628). FIG. 14C The p53 Y163C mutation is corrected by NBE3 in 7.6% of nucleofected human breast cancer cells (SEQ ID NO: 629).

FIGS. 16A to 16B show NBE1 is capable of correcting disease-relevant mutations in vitro. FIG. 16A: Protospacer and PAM sequences of seven disease-relevant mutations. The disease-associated target C in each case is indicated with a subscripted number reflecting its position within the protospacer. For all mutations except both APOE4 SNPs, the target C resides in the template (non-coding) strand. FIG. 16A depicts SEQ ID NOs: 631 through 636 from top to bottom, respectively. FIG. 16B: Deaminase assay showing each dsDNA oligonucleotide before (-) and after (+) incubation with NBE1, DNA isolation, and incubation with USER enzymes to cleave DNA at positions containing U. Positive control lanes from incubation of synthetic oligonucleotides containing U at various positions within the protospacer with USER enzymes are shown with the corresponding number indicating the position of the U.

FIG. 17 shows processivity of NBE1. The protospacer and PAM of a 60-mer DNA oligonucleotide containing eight consecutive Cs is shown at the top. The oligonucleotide (125 nM) was incubated with NBE1 (2 μM) for 2 h at 37° C. The DNA was isolated and analyzed by high-throughput sequencing. Shown are the percent of total reads for the most frequent nine sequences observed. The vast majority of edited strands (>93%) have more than one C converted to T. This figure depicts SEQ ID NO: 309.

FIGS. 18A to 18H show the effect of fusing UGI to NBE1 to generate NBE2. FIG. 18A: Protospacer and PAM sequences of the six mammalian cell genomic loci targeted with nucleobase editors. Editable Cs are indicated with labels corresponding to their positions within the protospacer. FIG. 18A depicts SEQ ID NOs: 127 through 132 from top to bottom, respectively. FIGS. 18B to 18G: HEK293T cells were transfected with plasmids expressing NBE1, NBE2, or NBE1 and UGI, and an appropriate sgRNA. Three days after transfection, genomic DNA was extracted and analyzed by high-throughput DNA sequencing at the six loci. Cellular C to T conversion percentages, defined as the percentage of total DNA sequencing reads with Ts at the target positions indicated, are shown for NBE1, NBE1 and UGI, and NBE2 at all six genomic loci. FIG. 18H: C to T mutation rates at 510 Cs surrounding the protospacers of interest for NBE1, NBE1 plus UGI on a separate plasmid, NBE2, and untreated cells are shown. The data show the results of 3,000,000 DNA sequencing reads from 1.5×106 cells. Values reflect the mean of at least two biological experiments conducted on different days.

19 shows nucleobase editing efficiencies of NBE2 in U2OS and HEK293T cells. Cellular C to T conversion percentages by NBE2 are shown for each of the six targeted genomic loci in HEK293T cells and U2OS cells. HEK293T cells were transfected using LIPOFECTAMINE® 2000 transfection reagent, and U2OS cells were nucleofected. U2OS nucleofection efficiency was 74%. Three days after plasmid delivery, genomic DNA was extracted and analyzed for nucleobase editing at the six genomic loci by HTS. Values and error bars reflect the mean and standard deviation of at least two biological experiments done on different days.

Figure 20:
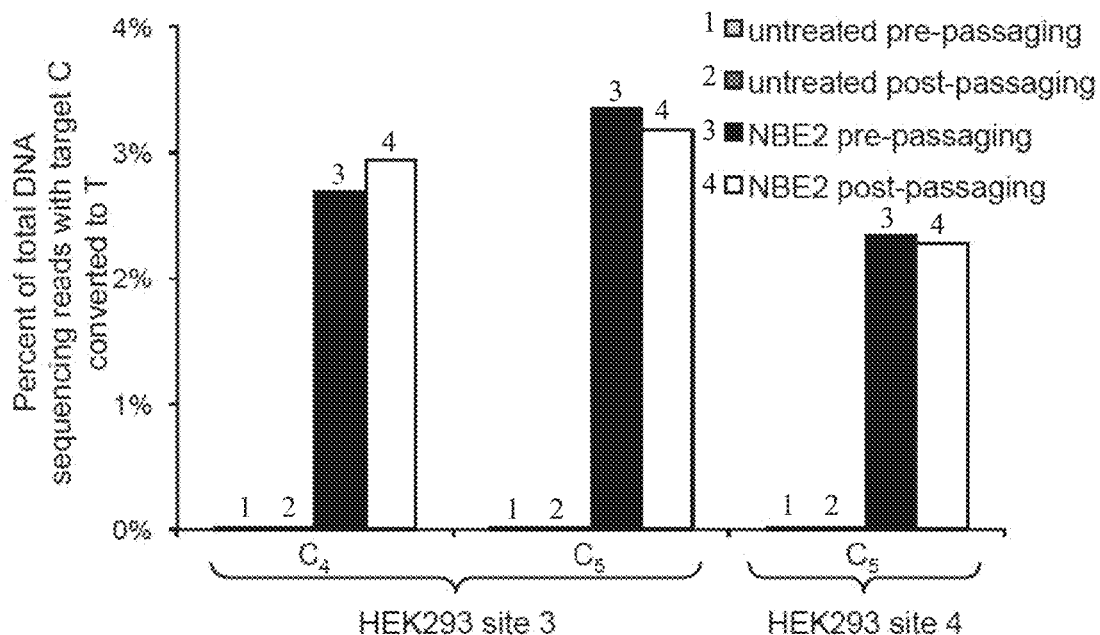

FIG. 20 shows nucleobase editing persists over multiple cell divisions. Cellular C to T conversion percentages by NBE2 are displayed at two genomic loci in HEK293T cells before and after passaging the cells. HEK293T cells were transfected using LIPOFECTAMINE® 2000 transfection reagent. Three days post transfection, the cells were harvested and split in half. One half was subjected to HTS analysis, and the other half was allowed to propagate for approximately five cell divisions, then harvested and subjected to HTS analysis.

Figure 21:
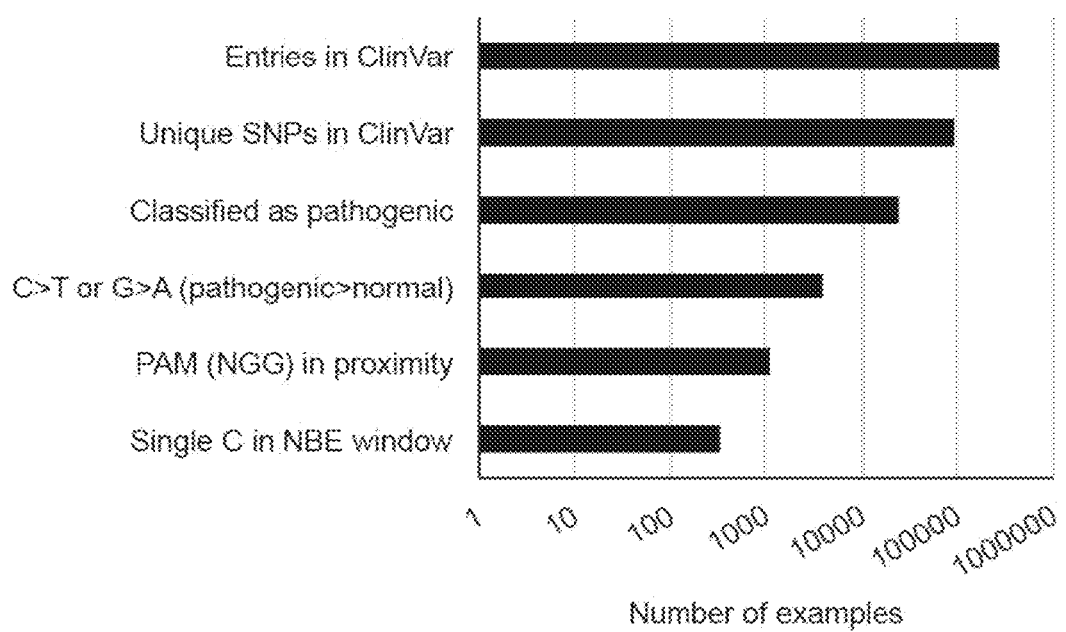

FIG. 21 shows genetic variants from ClinVar that can be corrected in principle by nucleobase editing. The NCBI ClinVar database of human genetic variations and their corresponding phenotypes[68] was searched for genetic diseases that can be corrected by current nucleobase editing technologies. The results were filtered by imposing the successive restrictions listed on the left. The x-axis shows the number of occurrences satisfying that restriction and all above restrictions on a logarithmic scale.

Figure 22A:
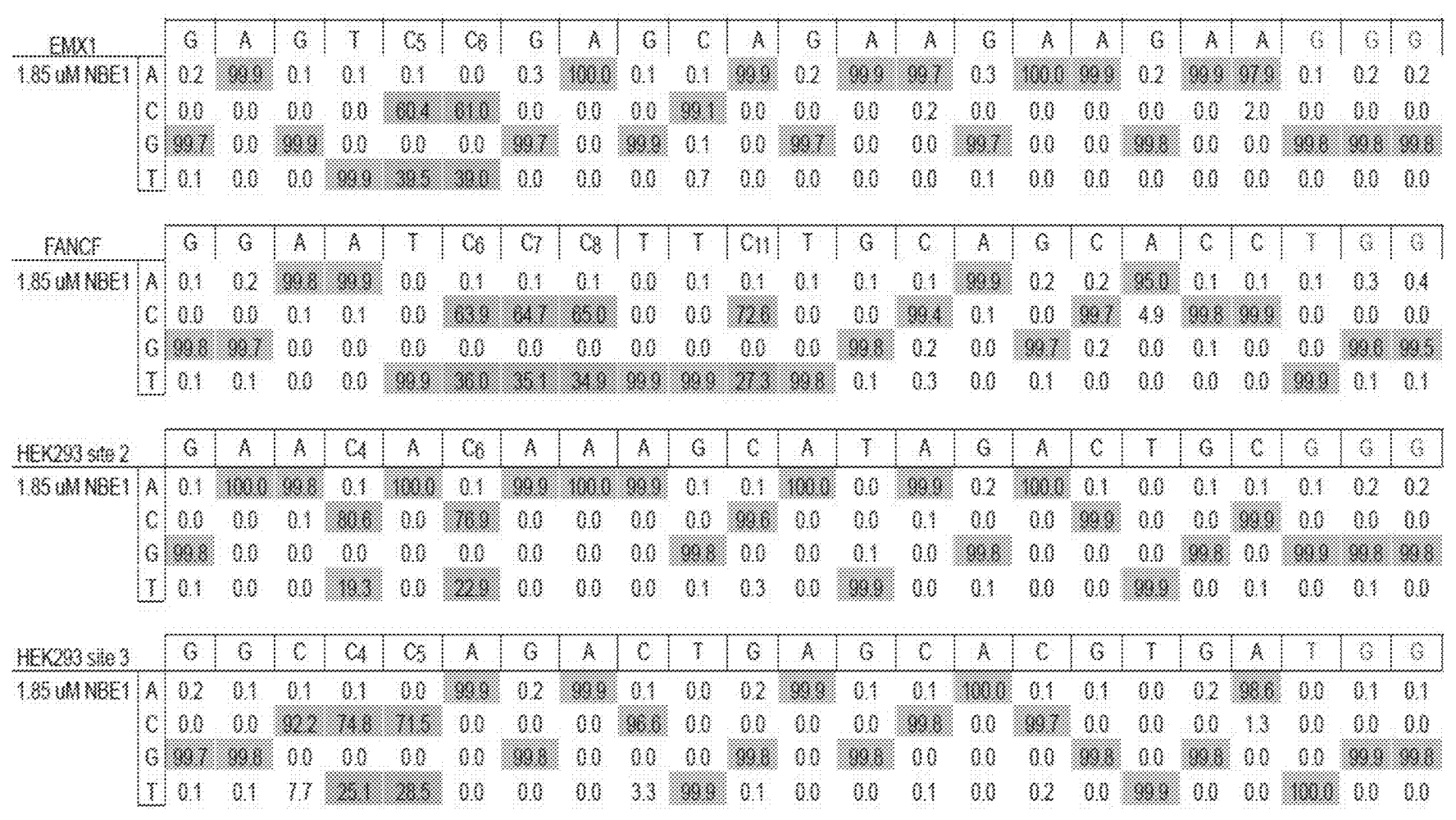
Figure 22B:
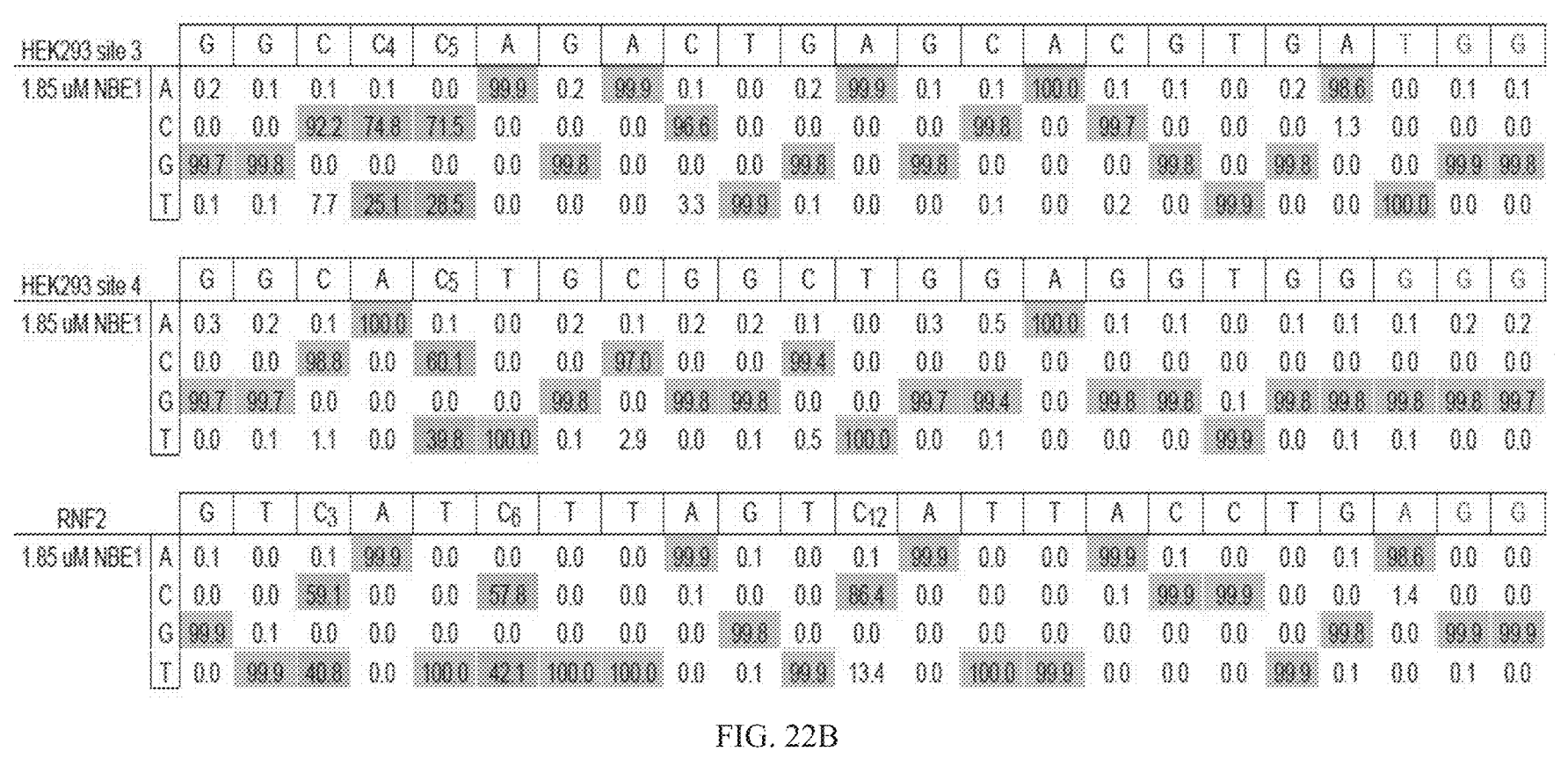

FIGS. 22A to 22B shows in vitro identification of editable Cs in six genomic loci. Synthetic 80-mers with sequences matching six different genomic sites were incubated with NBE1 then analyzed for nucleobase editing via HTS. For each site, the sequence of the protospacer is indicated to the right of the name of the site, with the PAM highlighted in red. Underneath each sequence are the percentages of total DNA sequencing reads with the corresponding base. A target C was considered as "editable" if the in vitro conversion efficiency is >10%. Note that maximum yields are 50% of total DNA sequencing reads since the non-targeted strand is not a substrate for nucleobase editing. This figure depicts SEQ ID NOs: 127 through 132 from top to bottom, respectively.

Figure 23A:
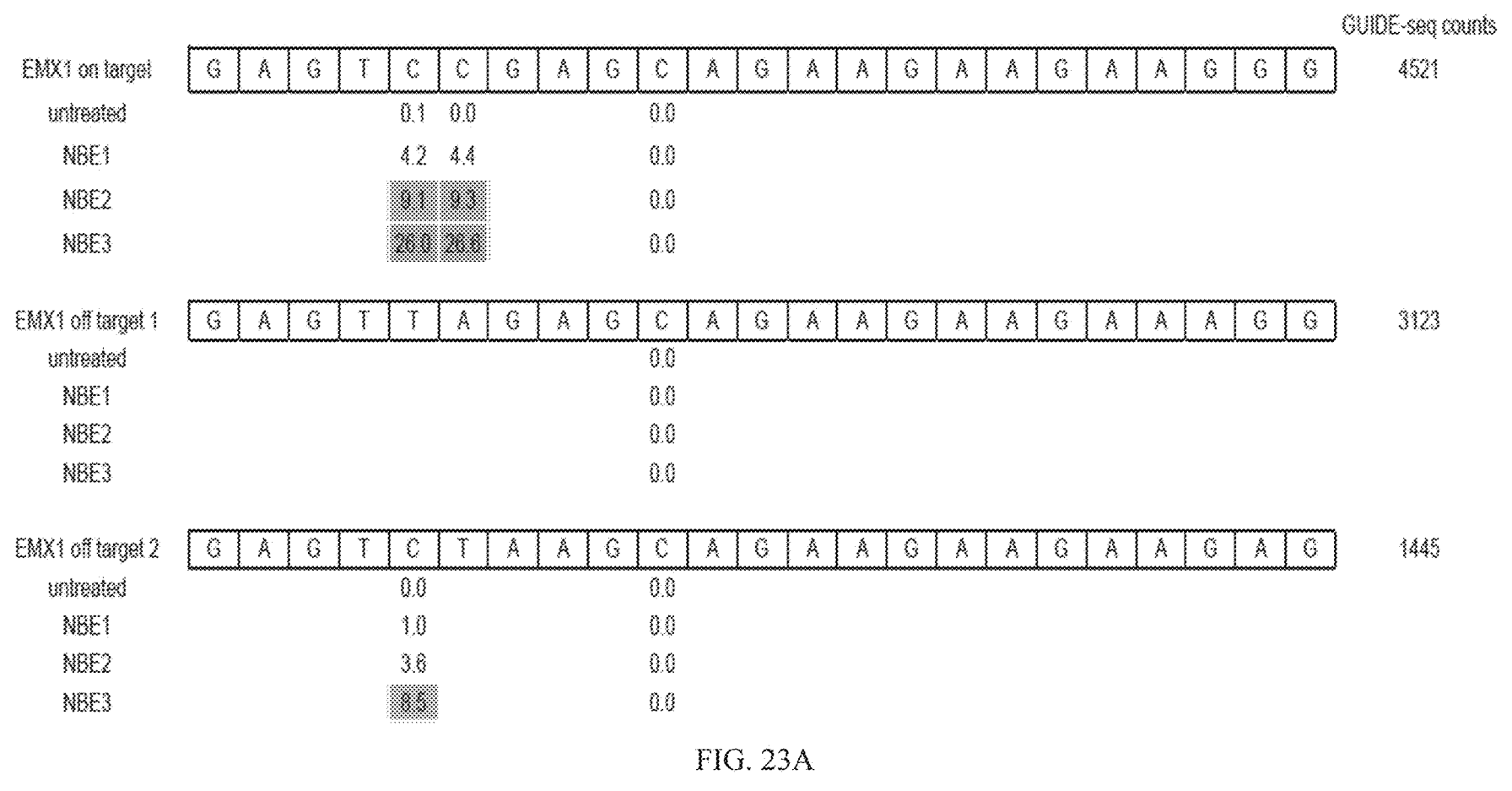
Figure 23B:
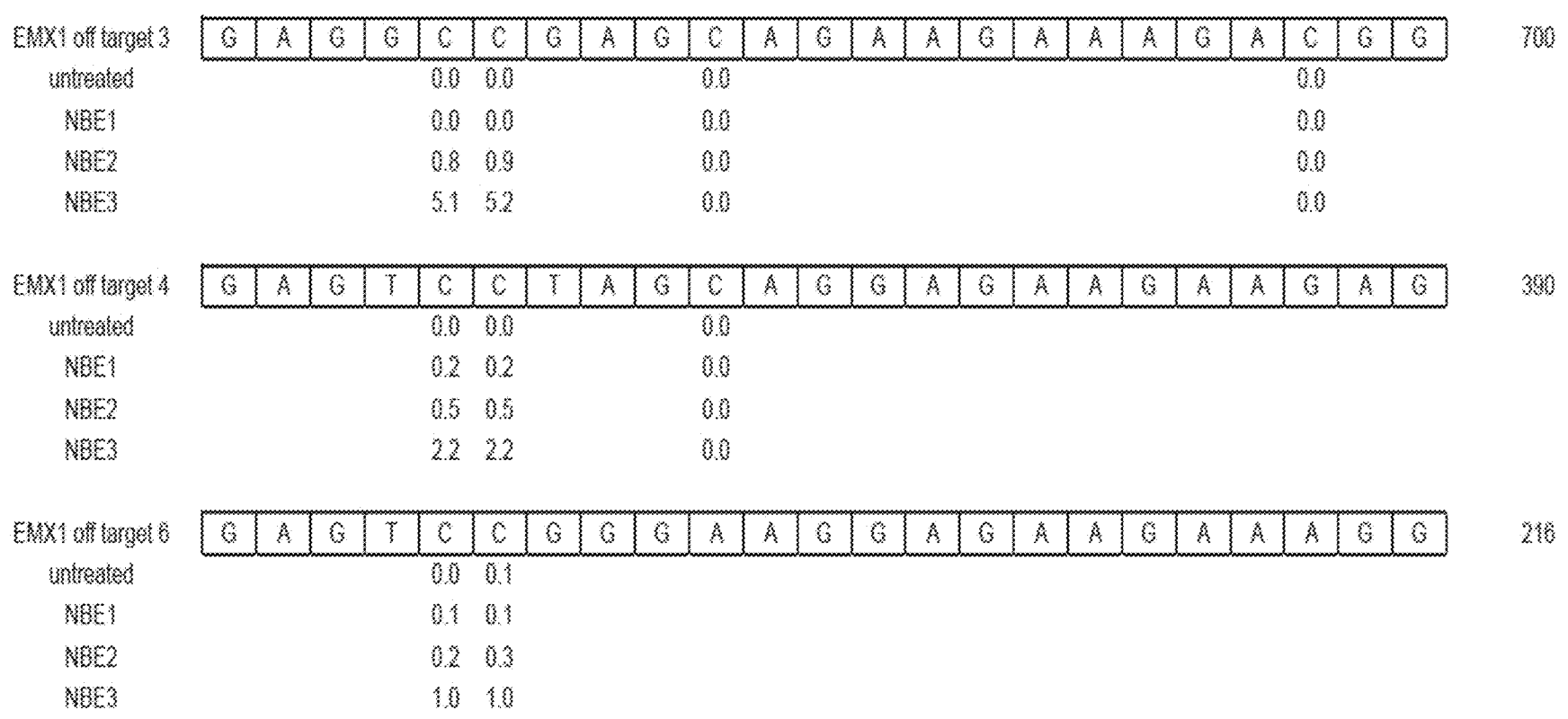
Figure 23C:
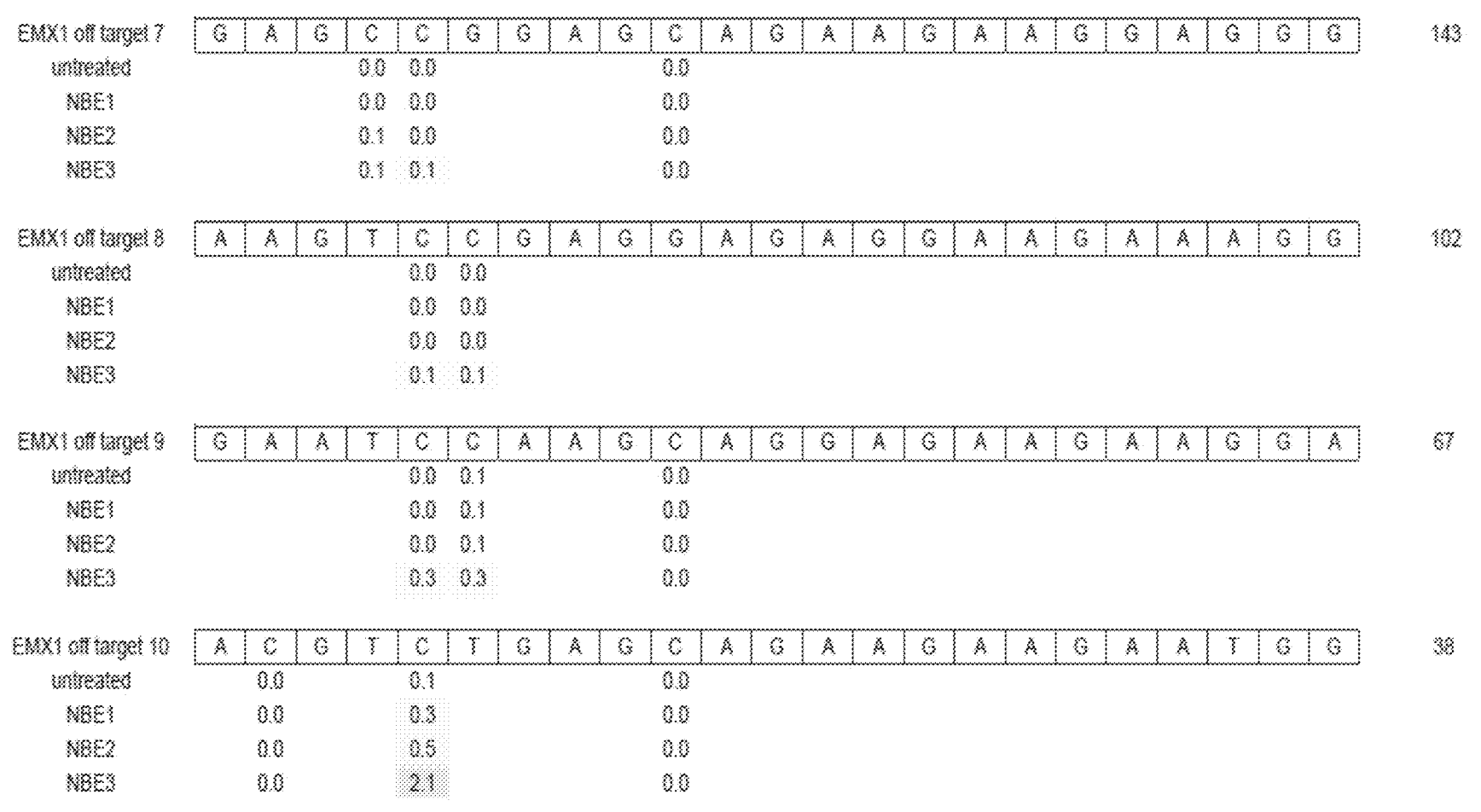

FIGS. 23A to 2C shows activities of NBE1, NBE2, and NBE3 at EMX1 off-targets. HEK293T cells were transfected with plasmids expressing NBE1, NBE2, or NBE3 and a sgRNA matching the EMX1 sequence using LIPOFECTAMINE® 2000 transfection reagent. Three days after transfection, genomic DNA was extracted, amplified by PCR, and analyzed by high-throughput DNA sequencing at the on-target loci, plus the top ten known Cas9 off-target loci for the EMX1 sgRNA, as previously determined using the GUIDE-seq method[55]. EMX1 off-target 5 locus did not amplify and is not shown. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 127, and 637 through 645 from top to bottom, respectively.

Figure 24A:
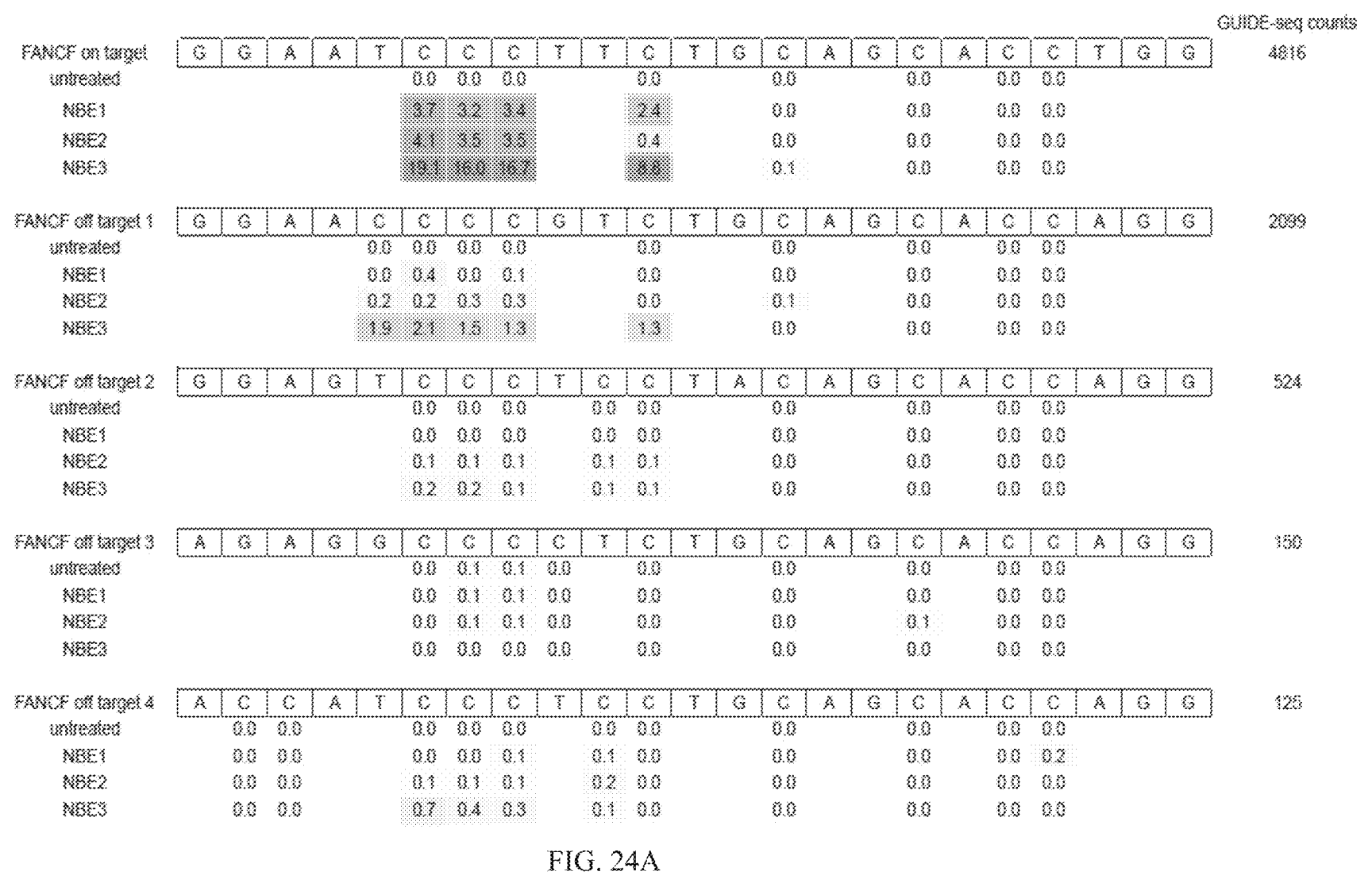
Figure 24B:
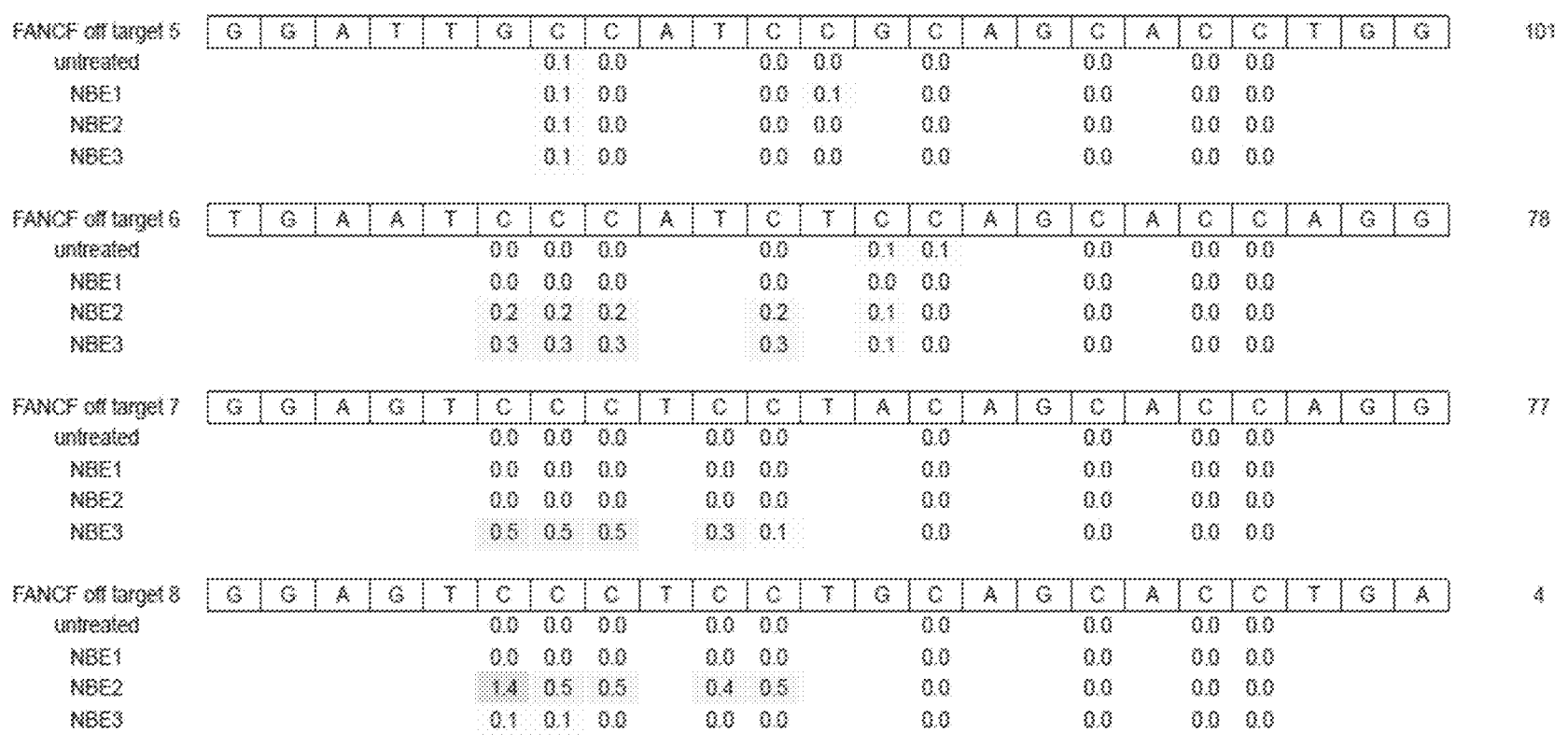

FIGS. 24A to 24B shows activities of NBE1, NBE2, and NBE3 at FANCF off-targets. HEK293T cells were transfected with plasmids expressing NBE1, NBE2, or NBE3 and a sgRNA matching the FANCF sequence using LIPOFECTAMINE® 2000 transfection reagent. Three days after transfection, genomic DNA was extracted, amplified by PCR, and analyzed by high-throughput DNA sequencing at the on-target loci, plus all of the known Cas9 off-target loci for the FANCF sgRNA, as previously determined using the GUIDE-seq method[55]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 128 and 646 through 653 from top to bottom, respectively.

Figure 25:
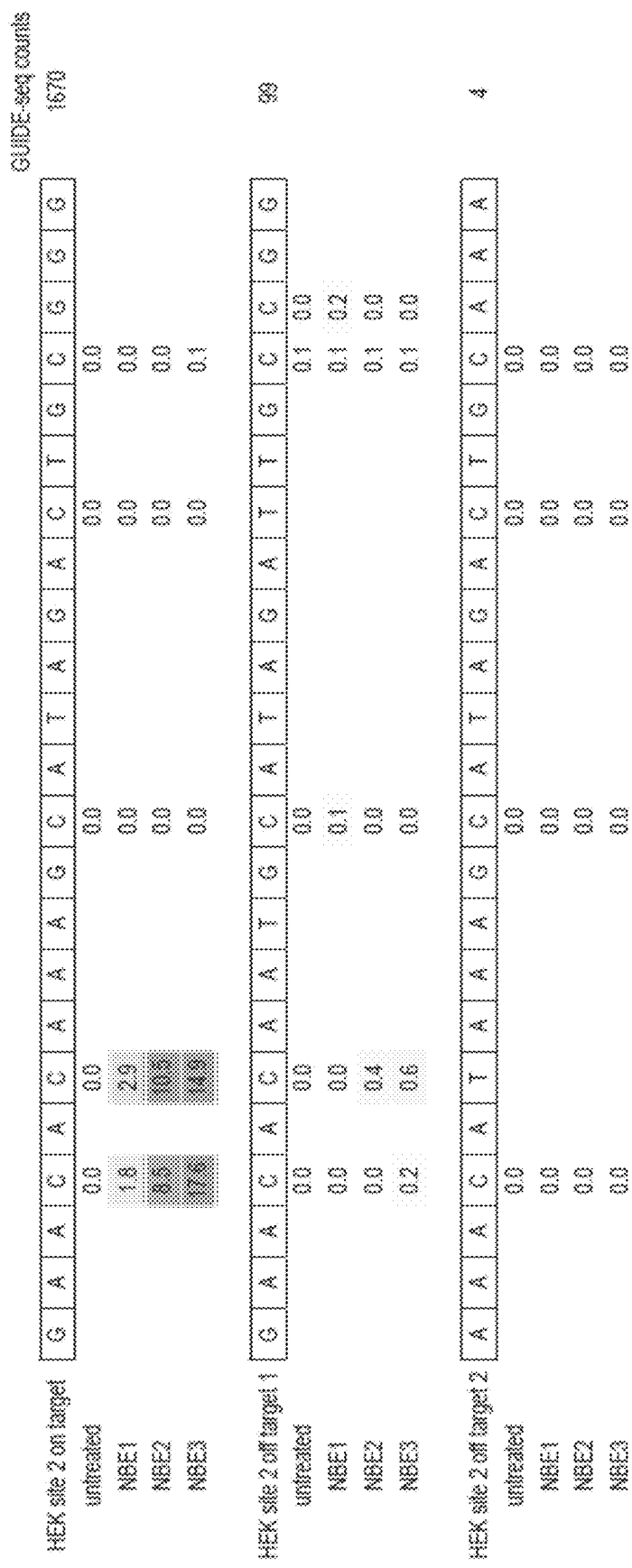

FIG. 25 shows activities of NBE1, NBE2, and NBE3 at HEK293 site 2 off-targets. HEK293T cells were transfected with plasmids expressing NBE1, NBE2, or NBE3 and a sgRNA matching the HEK293 site 2 sequence using LIPOFECTAMINE® 2000 transfection reagent. Three days after transfection, genomic DNA was extracted, amplified by PCR, and analyzed by high-throughput DNA sequencing at the on-target loci, plus all of the known Cas9 off-target loci for the HEK293 site 2 sgRNA, as previously determined using the GUIDE-seq method[55]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 129, 654, and 655 from top to bottom, respectively.

Figure 26:
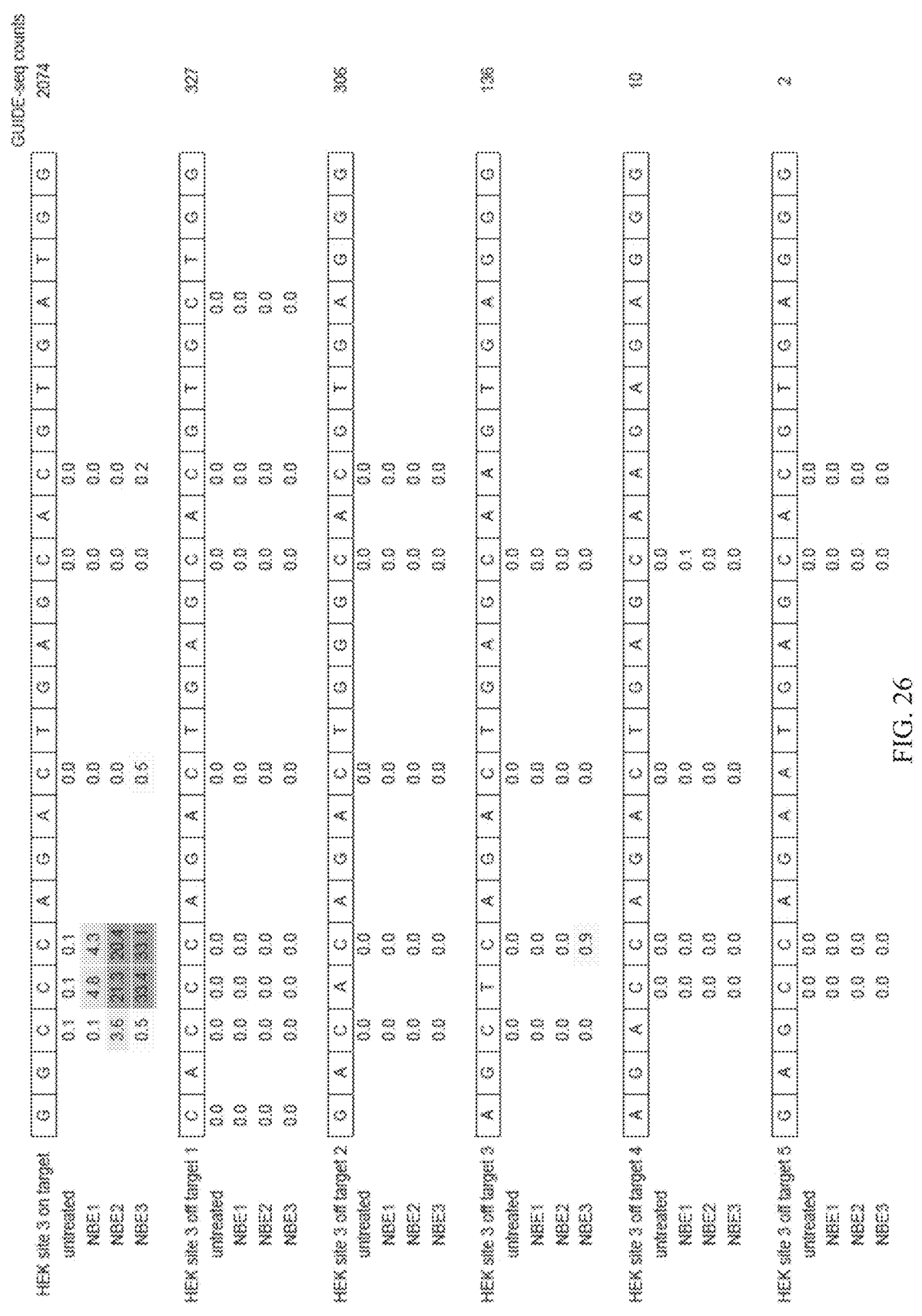

FIG. 26 shows activities of NBE1, NBE2, and NBE3 at HEK293 site 3 off-targets. HEK293T cells were transfected with plasmids expressing NBE1, NBE2, or NBE3 and a sgRNA matching the HEK293 site 3 sequence using LIPOFECTAMINE® 2000 transfection reagent. Three days after transfection, genomic DNA was extracted, amplified by PCR, and analyzed by high-throughput DNA sequencing at the on-target loci, plus all of the known Cas9 off-target loci for the HEK293 site 3 sgRNA, as previously determined using the GUIDE-seq method.[55] Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 130 and 656 through 660 from top to bottom, respectively.

Figure 27A:
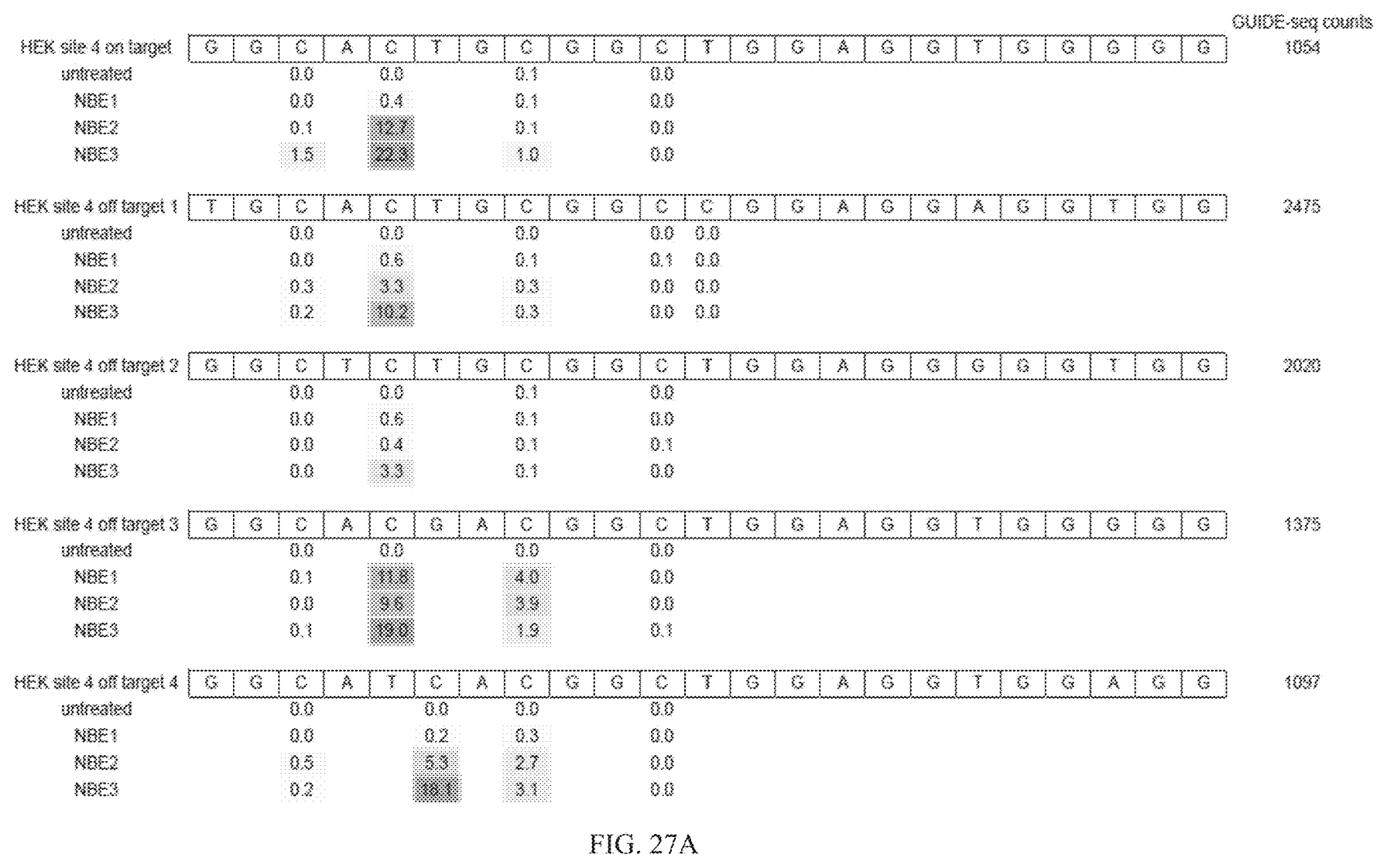
Figure 27B:
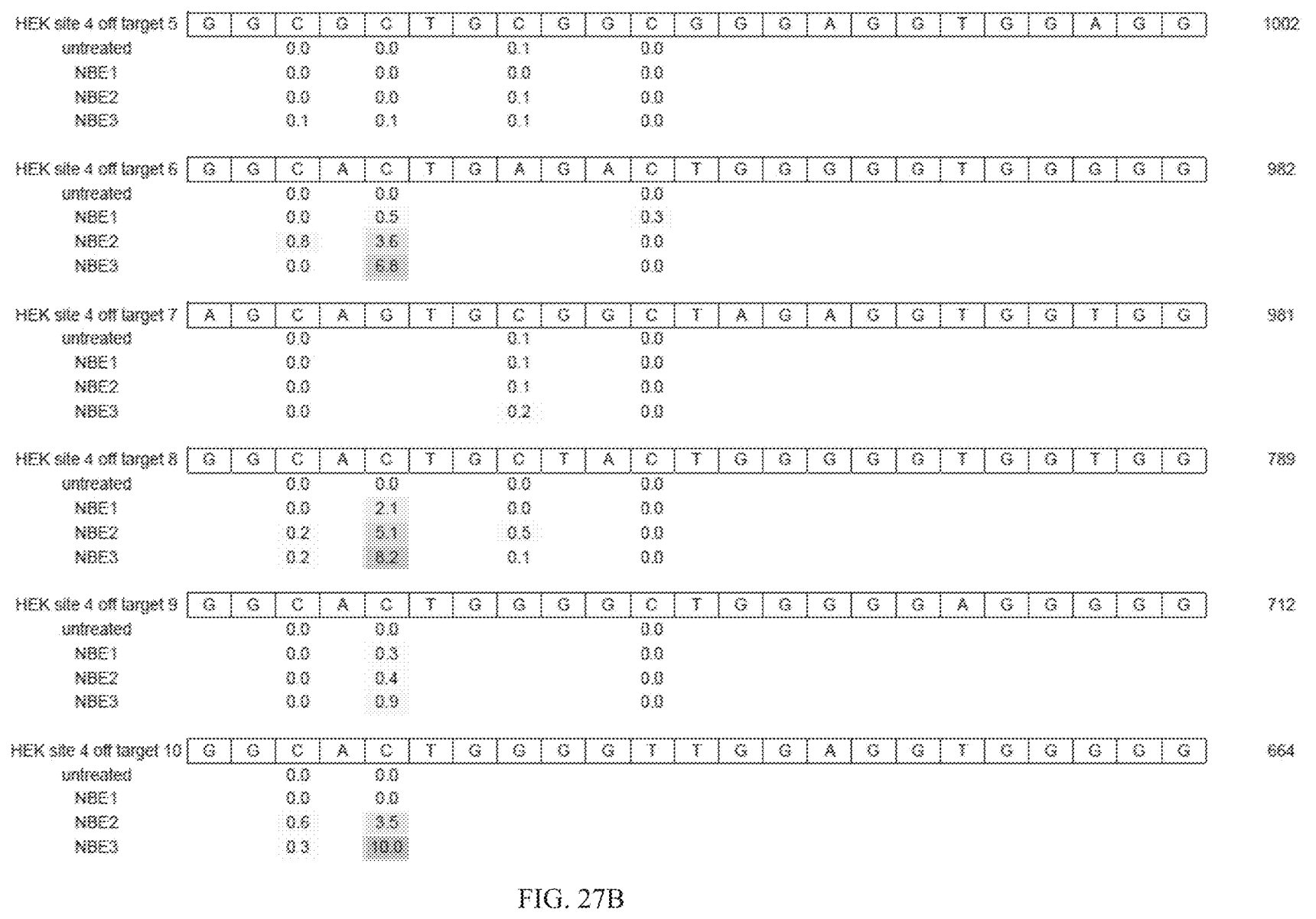

FIGS. 27A to 27B shows activities of NBE1, NBE2, and NBE3 at HEK293 site 4 off-targets. HEK293T cells were transfected with plasmids expressing NBE1, NBE2, or NBE3 and a sgRNA matching the HEK293 site 4 sequence using LIPOFECTAMINE® 2000 transfection reagent. Three days after transfection, genomic DNA was extracted, amplified by PCR, and analyzed by high-throughput DNA sequencing at the on-target loci, plus the top ten known Cas9 off-target loci for the HEK293 site 4 sgRNA, as previously determined using the GUIDE-seq method.[55] Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 131 and 661 through 670 from top to bottom, respectively.

Figures 28, 29A:
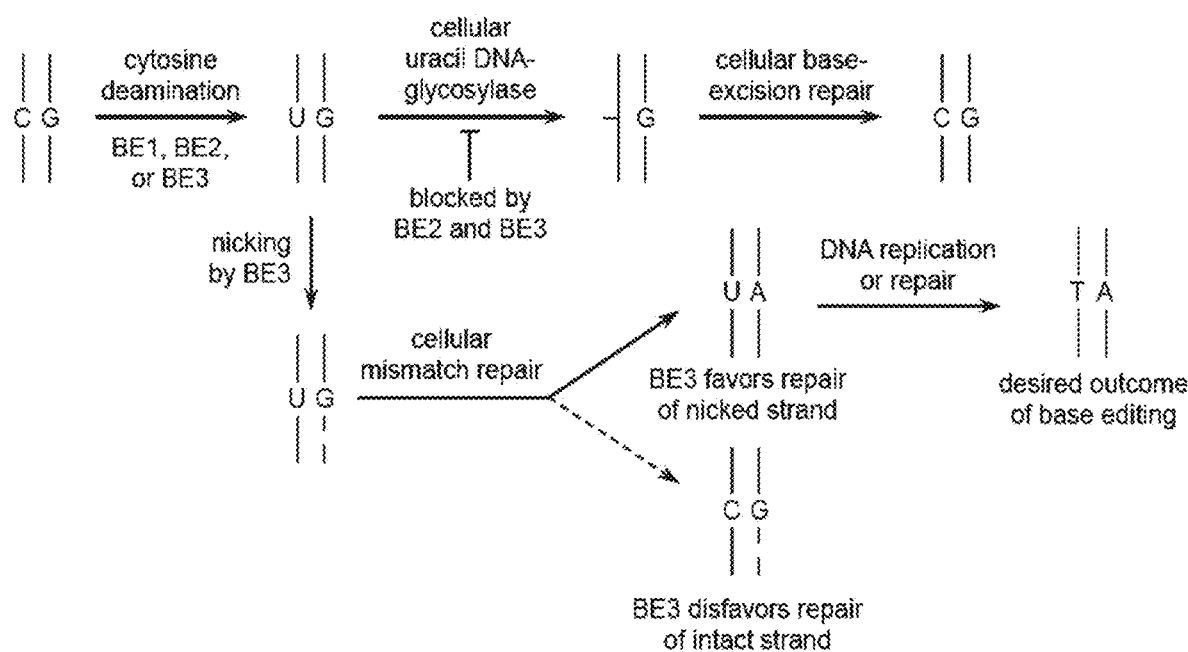

FIG. 28 shows non-target C mutation rates. Shown here are the C to T mutation rates at 2,500 distinct cytosines surrounding the six on-target and 34 off-target loci tested, representing a total of 14,700,000 sequence reads derived from approximately 1.8×10⁶ cells.

Figure 29B:
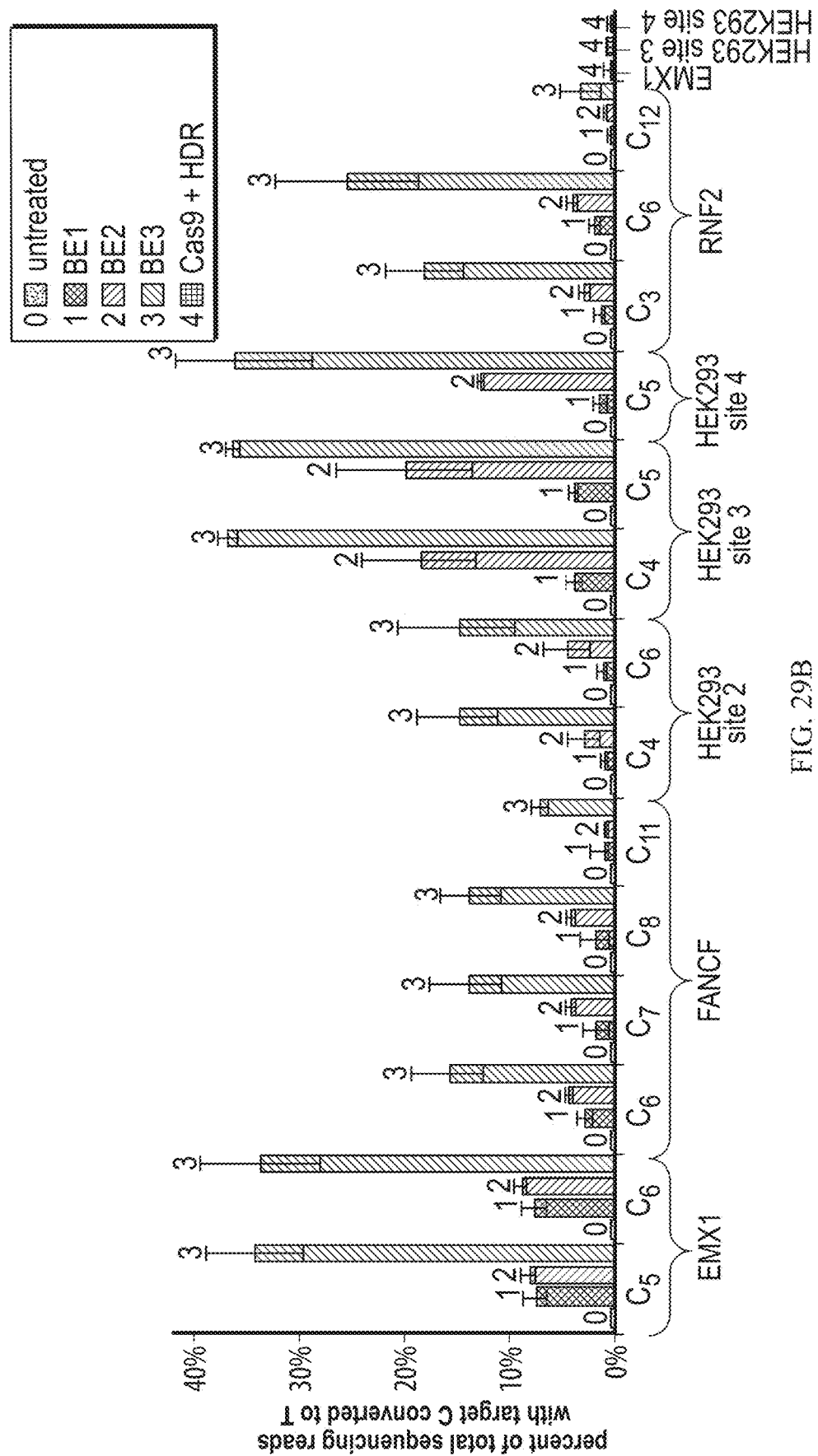
Figure 29C:
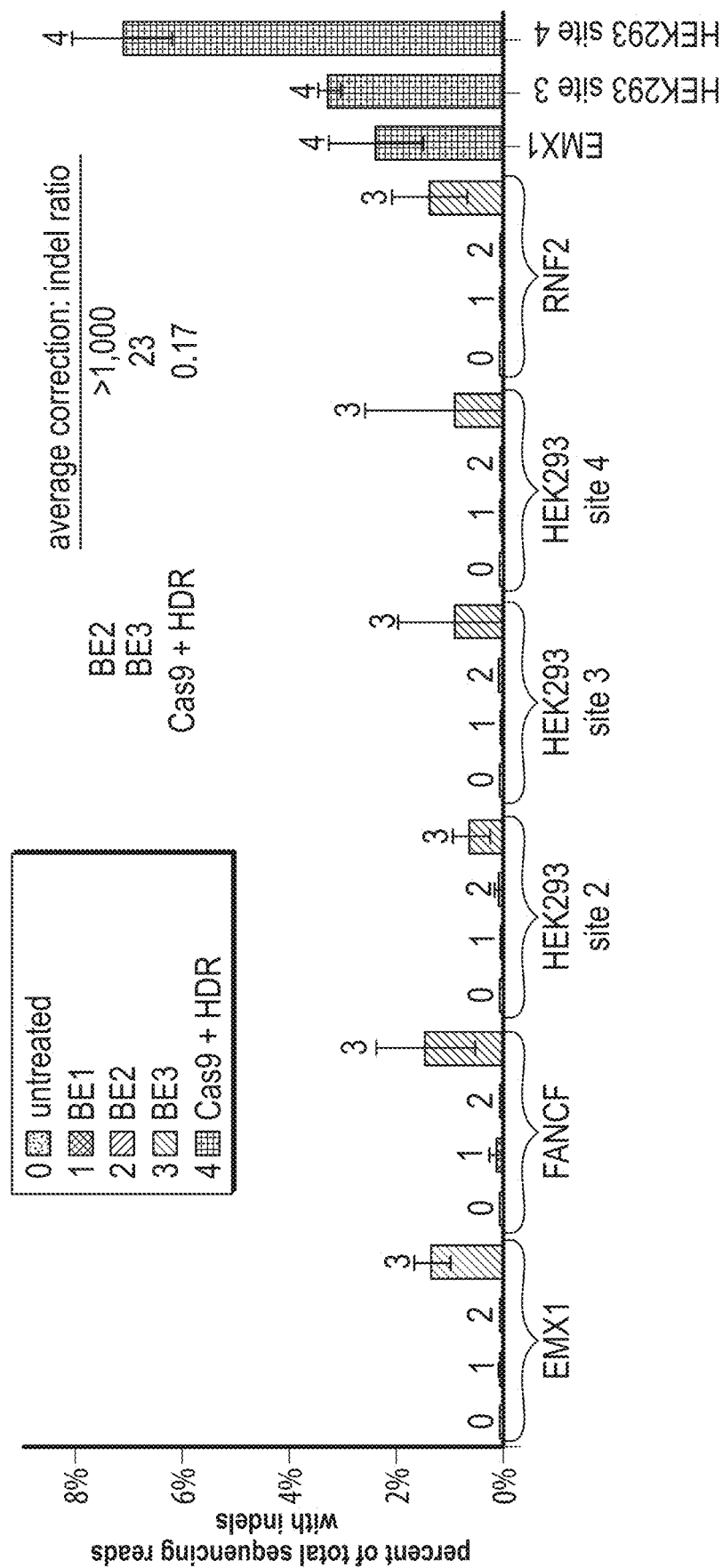

FIGS. 29A to 29C show base editing in human cells. FIG. 29A shows possible base editing outcomes in mammalian cells. Initial editing resulted in a U:G mismatch. Recognition and excision of the U by uracil DNA glycosylase (UDG) initiated base excision repair (BER), which lead to reversion to the C:G starting state. BER was impeded by BE2 and BE3, which inhibited UDG. The U:G mismatch was also processed by mismatch repair (MMR), which preferentially repaired the nicked strand of a mismatch. BE3 nicked the non-edited strand containing the G, favoring resolution of the U:G mismatch to the desired U:A or T:A outcome. FIG.

29B shows HEK293T cells treated as described in the Materials and Methods in the Examples below. The percentage of total DNA sequencing read with Ts at the target positions indicated show treatment with BE1, BE2, or BE3, or for treatment with wt Cas9 with a donor HDR template. FIG. 29C shows frequency of indel formation following the treatment in FIG. 29B. Values are listed in FIG. 34. For FIGS. 29B and 29C, values and error bars reflect the mean and s.d. of three independent biological replicates performed on different days.

Figure 30A:
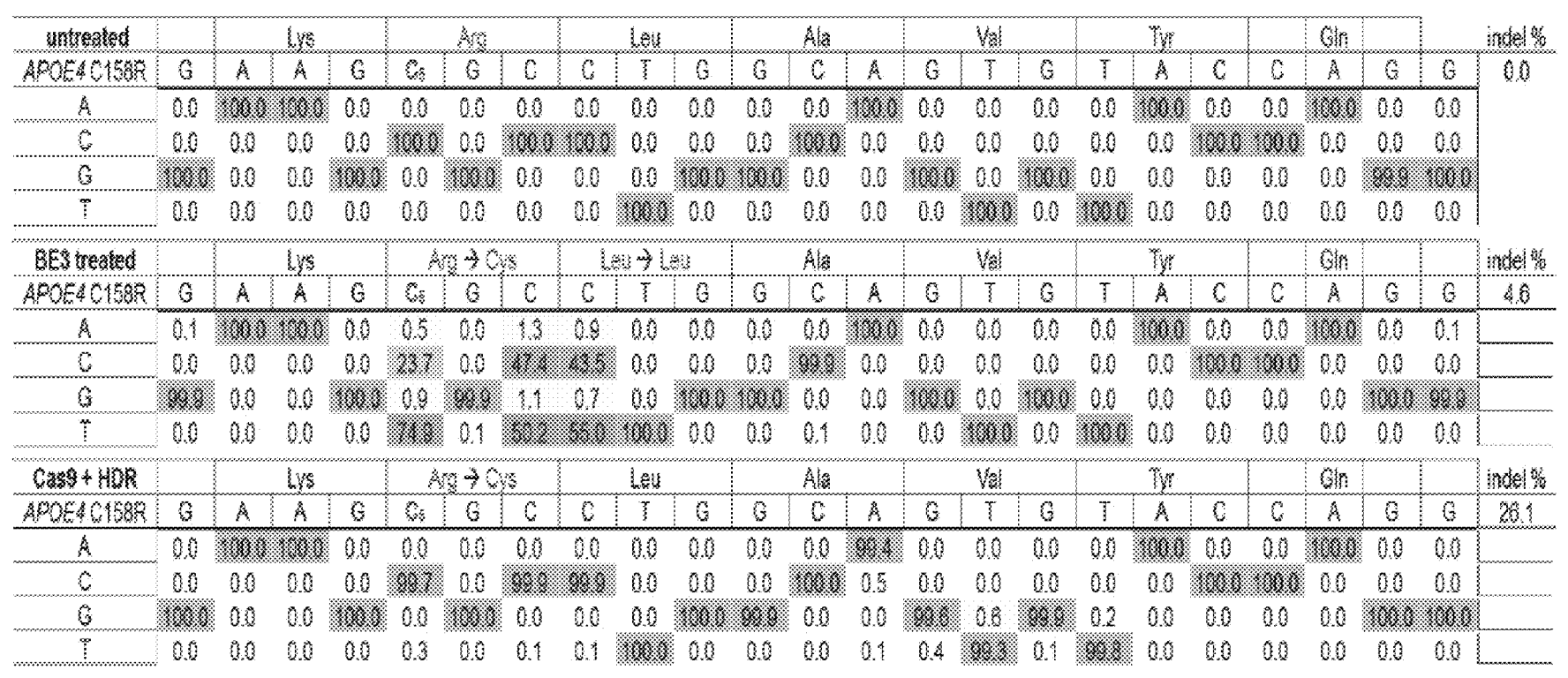
Figure 30B:
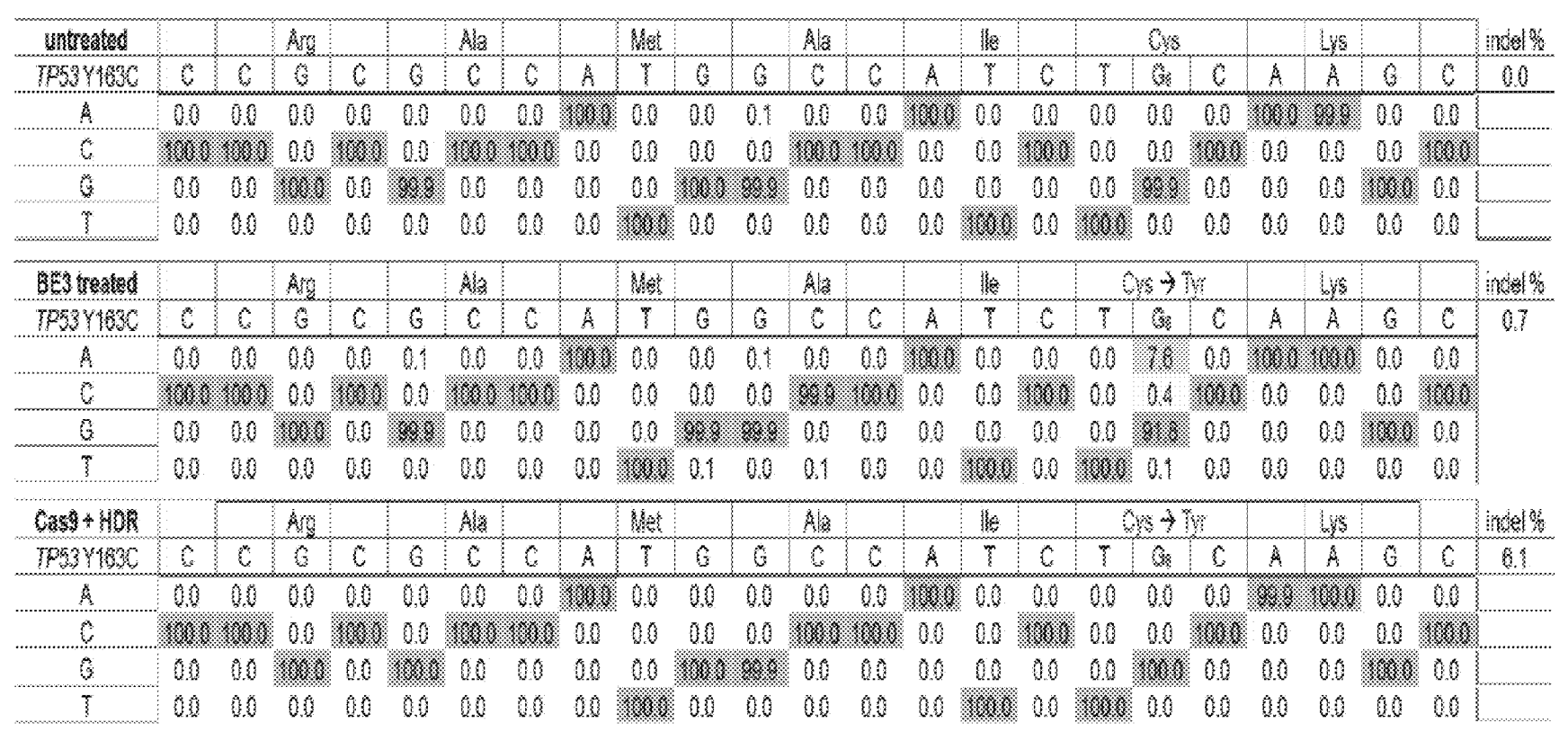

FIGS. 30A to 30B show BE3-mediated correction of two disease-relevant mutations in mammalian cells. The sequence of the protospacer is shown to the right of the mutation, with the PAM and the target base in red with a subscripted number indicating its position within the protospacer. Underneath each sequence are the percentages of total sequencing reads with the corresponding base. Cells were treated as described in the Materials and Methods. FIG. 30A shows the Alzheimer's disease-associated APOE4 allele converted to APOE3r in mouse astrocytes by BE3 in 74.9% of total reads. Two nearby Cs were also converted to Ts, but with no change to the predicted sequence of the resulting protein. Identical treatment of these cells with wt Cas9 and donor ssDNA results in only 0.3% correction, with 26.1% indel formation. This figure depicts SEQ ID NOs: 671 and 627. FIG. 30B shows the cancer associated p53 Y163C mutation corrected by BE3 in 7.6% of nucleofected human breast cancer cells with 0.7% indel formation. Identical treatment of these cells with wt Cas9 and donor ssDNA results in no mutation correction with 6.1% indel formation. This figure depicts SEQ ID NOs: 672 and 629.

Figure 31A:
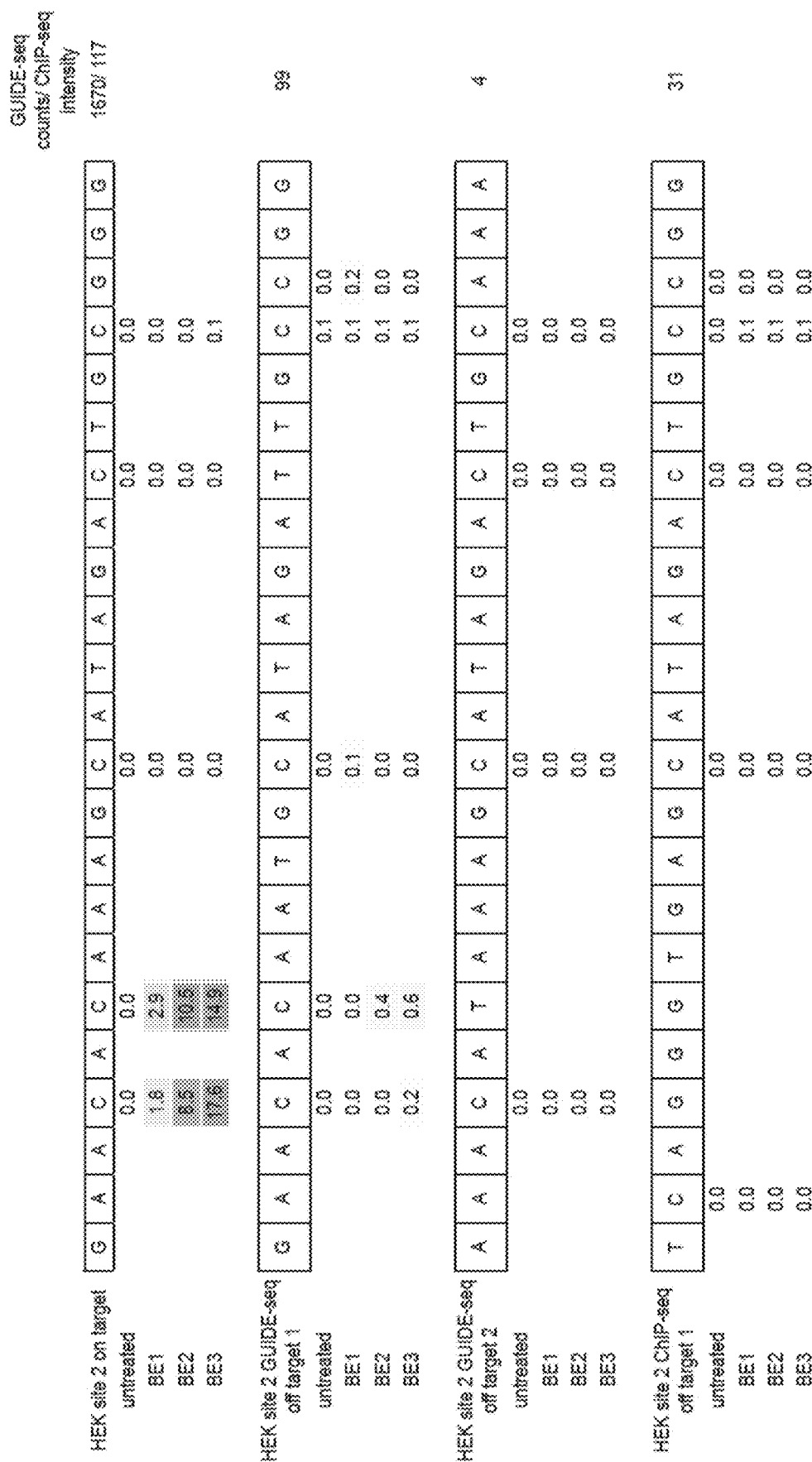

FIGS. 31A to 31B shows activities of BE1, BE2, and BE3 at HEK293 site 2 off-targets. HEK293T cells were transfected with plasmids expressing BE1, BE2, or BE3 and a sgRNA matching the HEK293 site 2 sequence using LIPOFECTAMINE® 2000 transfection reagent. Three days after transfection, genomic DNA was extracted, amplified by PCR, and analyzed by high-throughput DNA sequencing at the on-target loci, plus all of the known Cas9 and dCas9 off-target loci for the HEK293 site 2 sgRNA, as previously determined by Joung and coworkers using the GUIDE-seq method (63), and Adli and coworkers using chromatin immunoprecipitation high-throughput sequencing (ChIP-seq) experiments (18). Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for BE1, BE2, and BE3. On the far right are displayed the total number of sequencing reads reported, and the ChIP-seq signal intensity reported for each sequence. This figure depicts SEQ ID NOs: 129, 654, 655 and 673 to 677 from top to bottom, respectively.

Figure 32A:
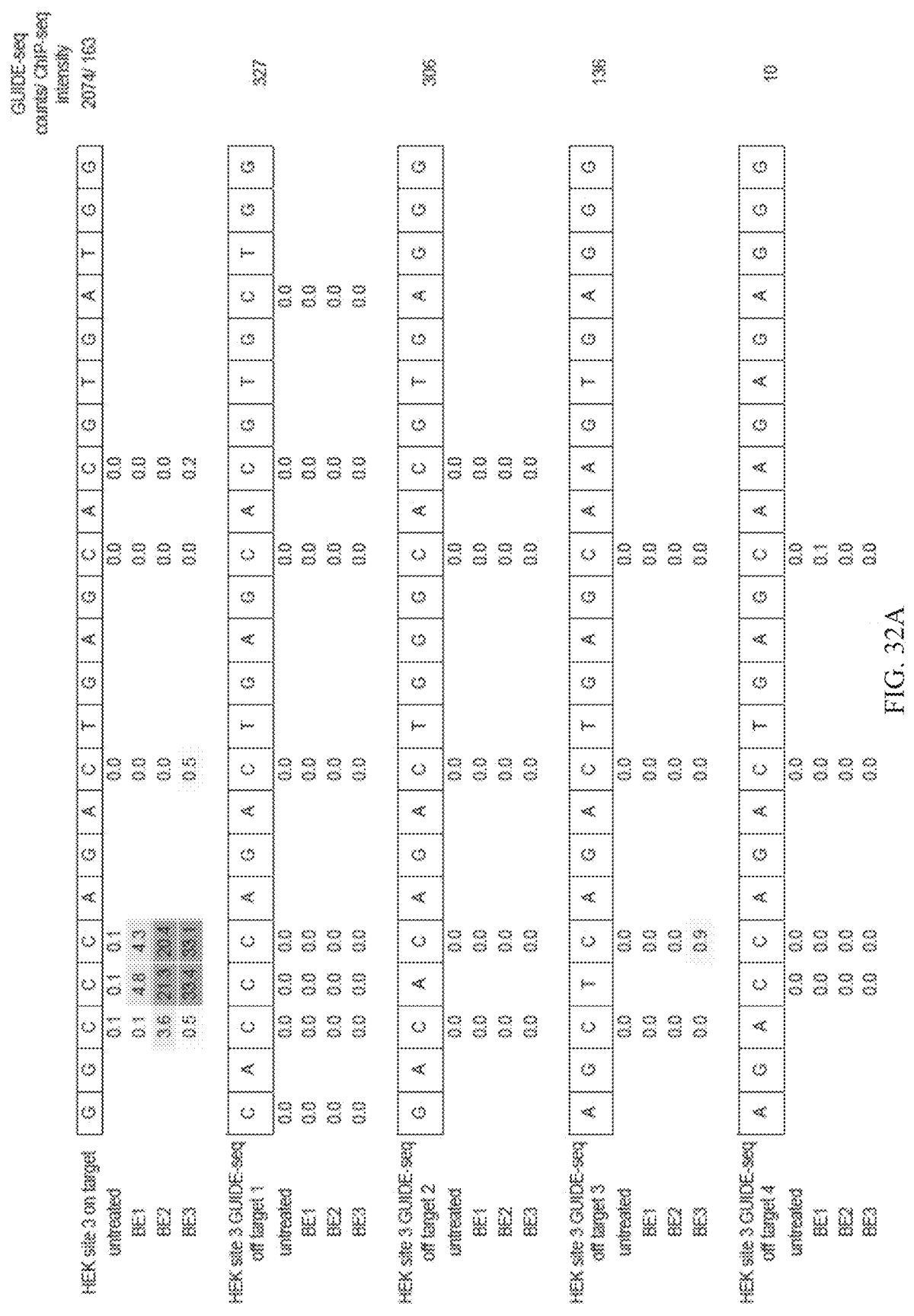
Figure 32B:
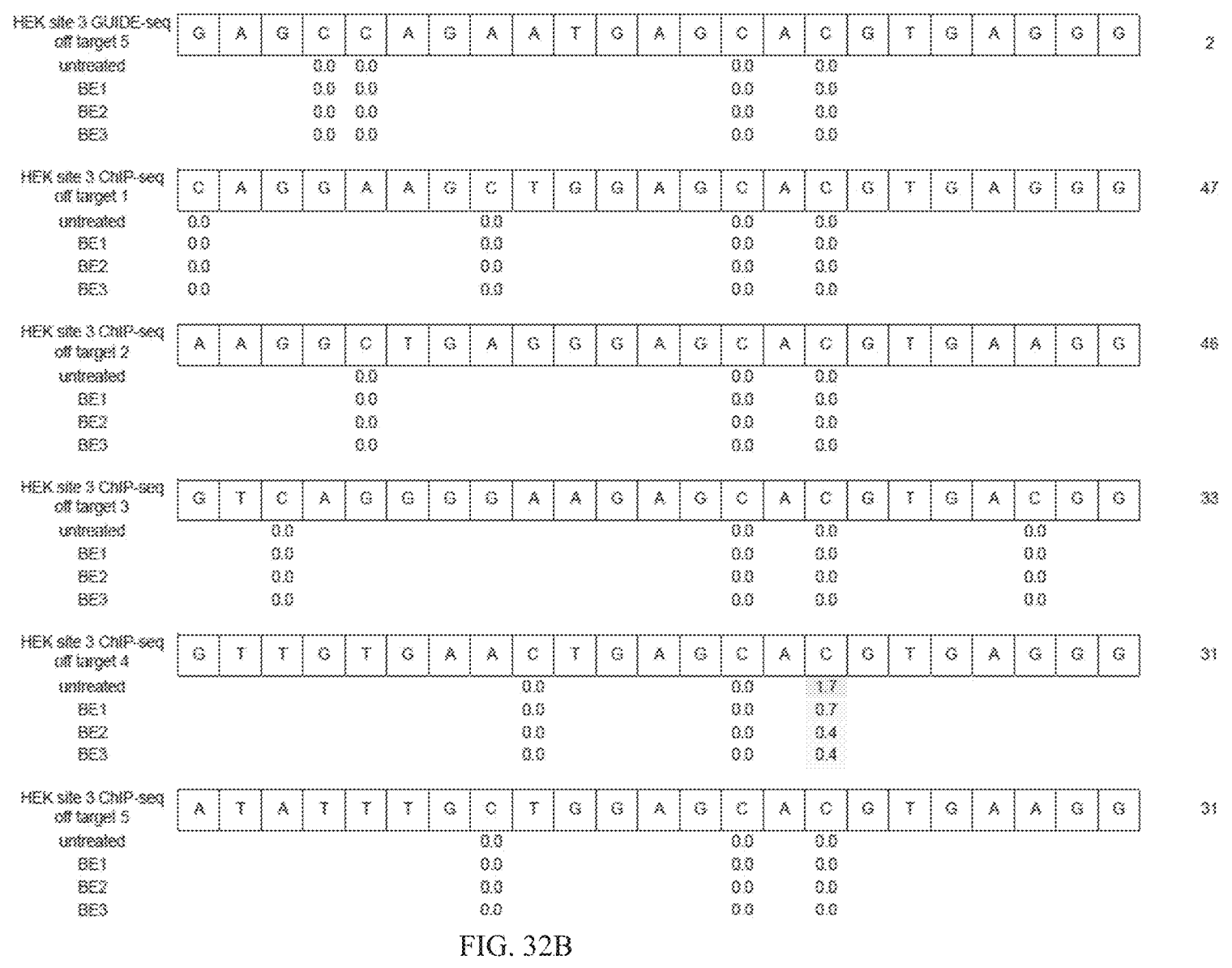

FIGS. 32A to 32B shows activities of BE1, BE2, and BE3 at HEK293 site 3 off-targets. HEK293T cells were transfected with plasmids expressing BE1, BE2, or BE3 and a sgRNA matching the HEK293 site 3 sequence using LIPOFECTAMINE® 2000 transfection reagent. Three days after transfection, genomic DNA was extracted, amplified by PCR, and analyzed by high-throughput DNA sequencing at the on-target loci, plus all of the known Cas9 off-target loci and the top five known dCas9 off-target loci for the HEK293 site 3 sgRNA, as previously determined by Joung and coworkers using the GUIDE-seq method[54], and using chromatin immunoprecipitation high-throughput sequencing (ChIP-seq) experiments[61]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for BE1, BE2, and BE3. On the far right are displayed the total number of sequencing reads reported, and the ChIP-seq signal intensity reported for each sequence. This figure depicts SEQ ID NOs: 130, 656 to 660 and 678-682 from top to bottom, respectively.

Figure 33A:
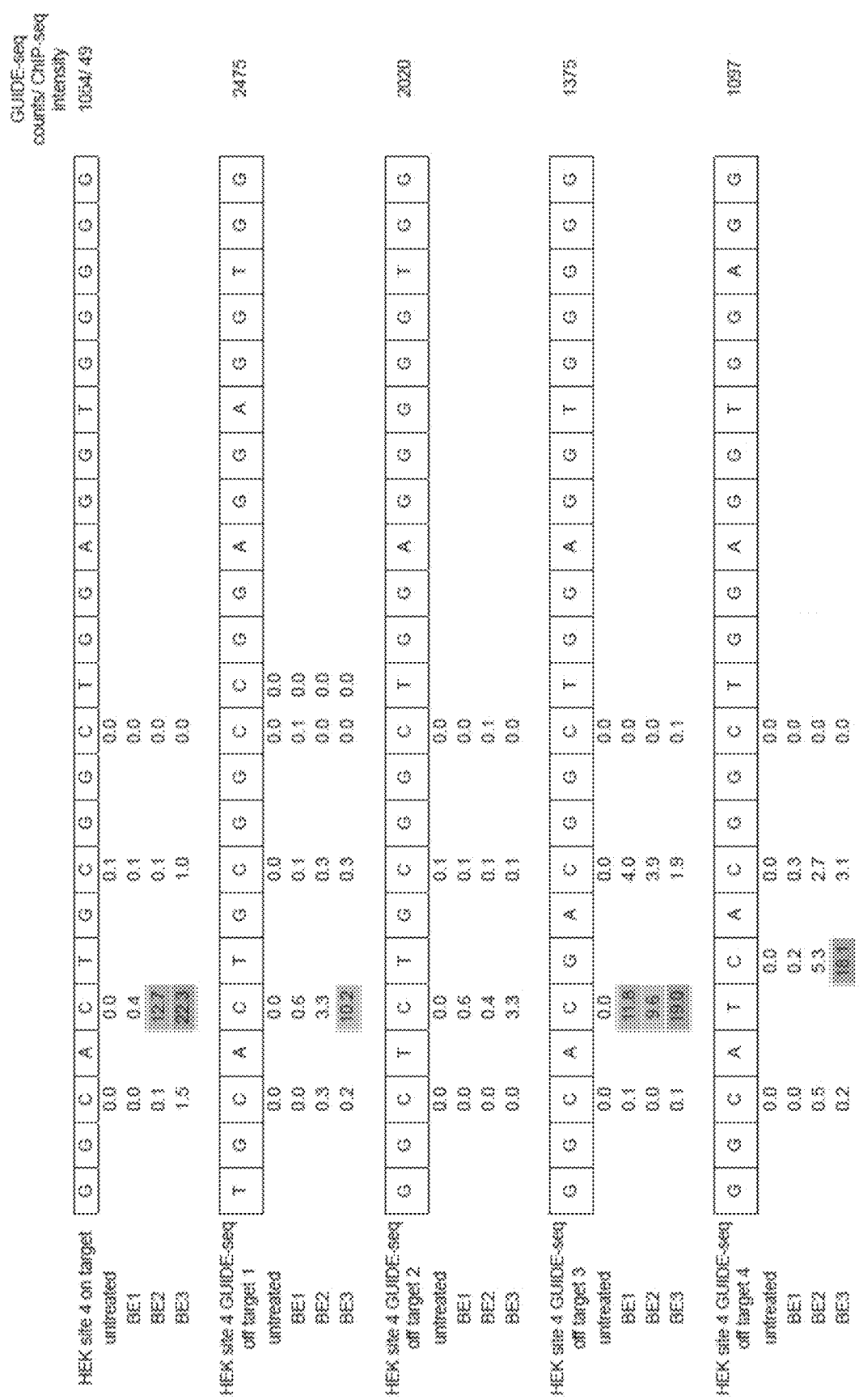
Figure 33B:
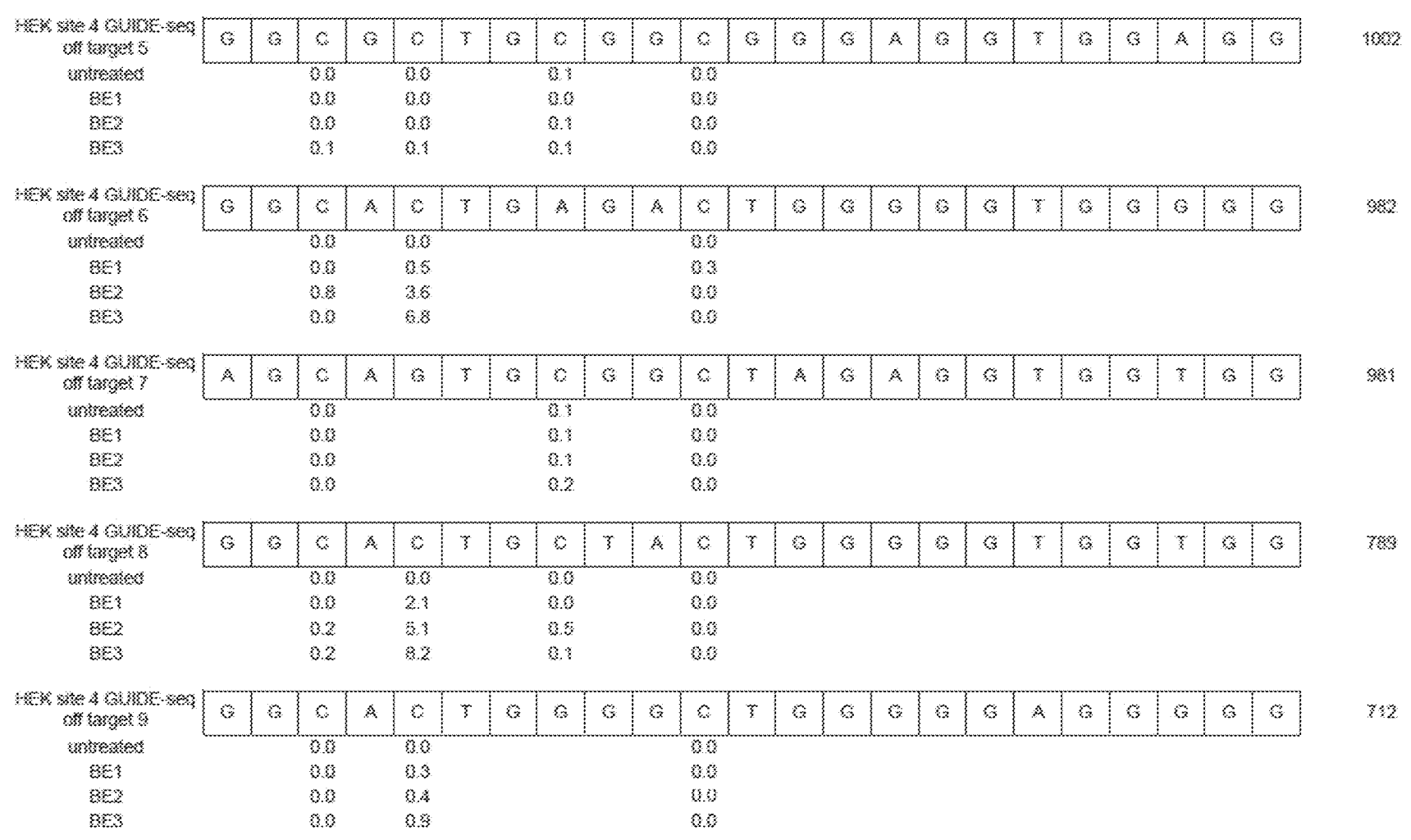
Figure 33C:
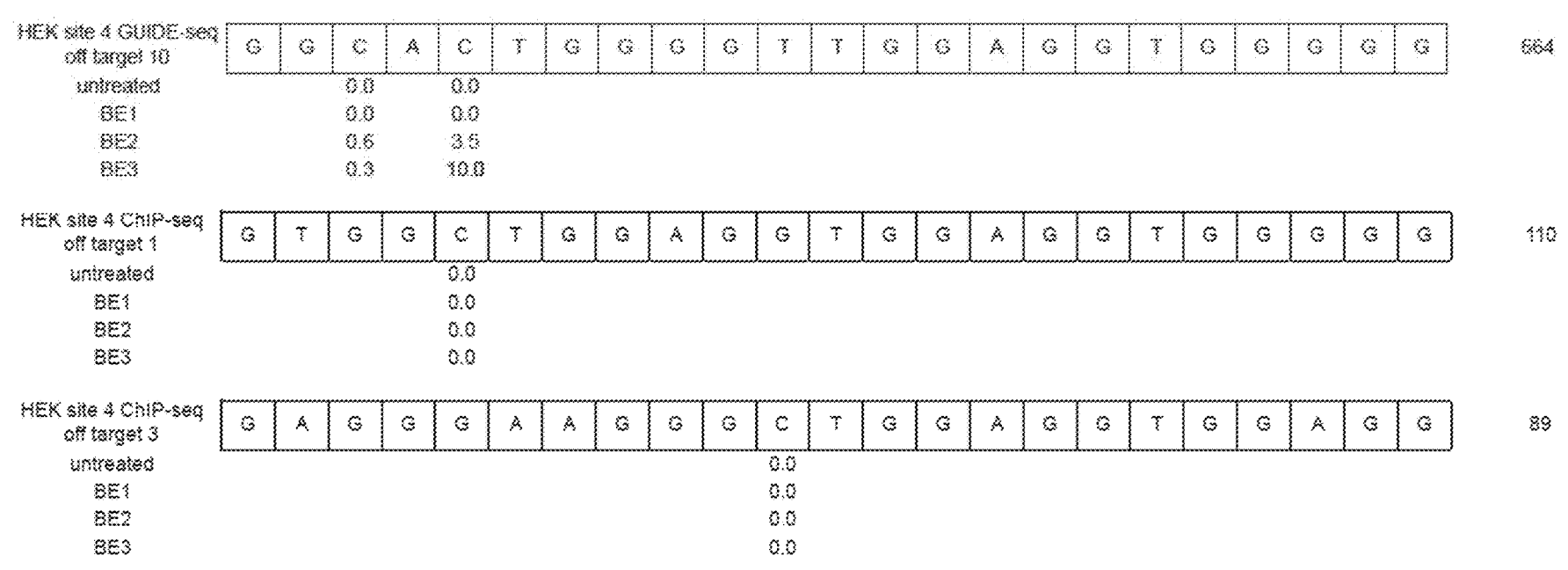

FIGS. 33A to 33C shows activities of BE1, BE2, and BE3 at HEK293 site 4 off-targets. HEK293T cells were transfected with plasmids expressing BE1, BE2, or BE3 and a sgRNA matching the HEK293 site 4 sequence using LIPOFECTAMINE® 2000 transfection reagent. Three days after transfection, genomic DNA was extracted, amplified by PCR, and analyzed by high-throughput DNA sequencing at the on-target loci, plus the top ten known Cas9 off-target loci and the top five known dCas9 off-target loci for the HEK293 site 4 sgRNA, as previously determined using the GUIDE-seq method[54], and using chromatin immunoprecipitation high-throughput sequencing (ChIP-seq) experiments[61]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for BE1, BE2, and BE3. On the far right are displayed the total number of sequencing reads reported, and the ChIP-seq signal intensity reported for each sequence. This figure depicts SEQ ID NOs: 131, 661 to 670, 683 and 684 from top to bottom, respectively.

Figure 34A:
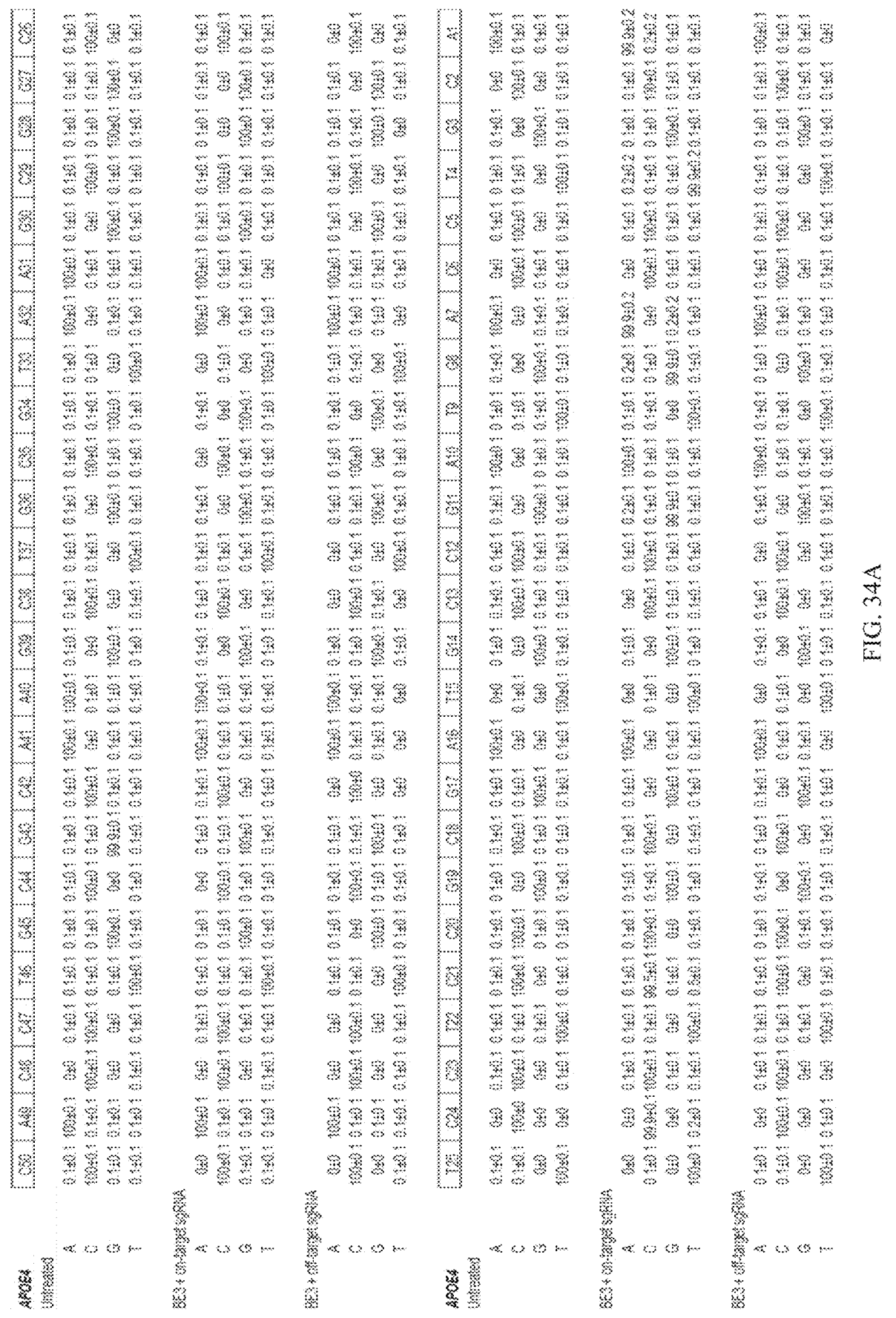
Figure 34B:
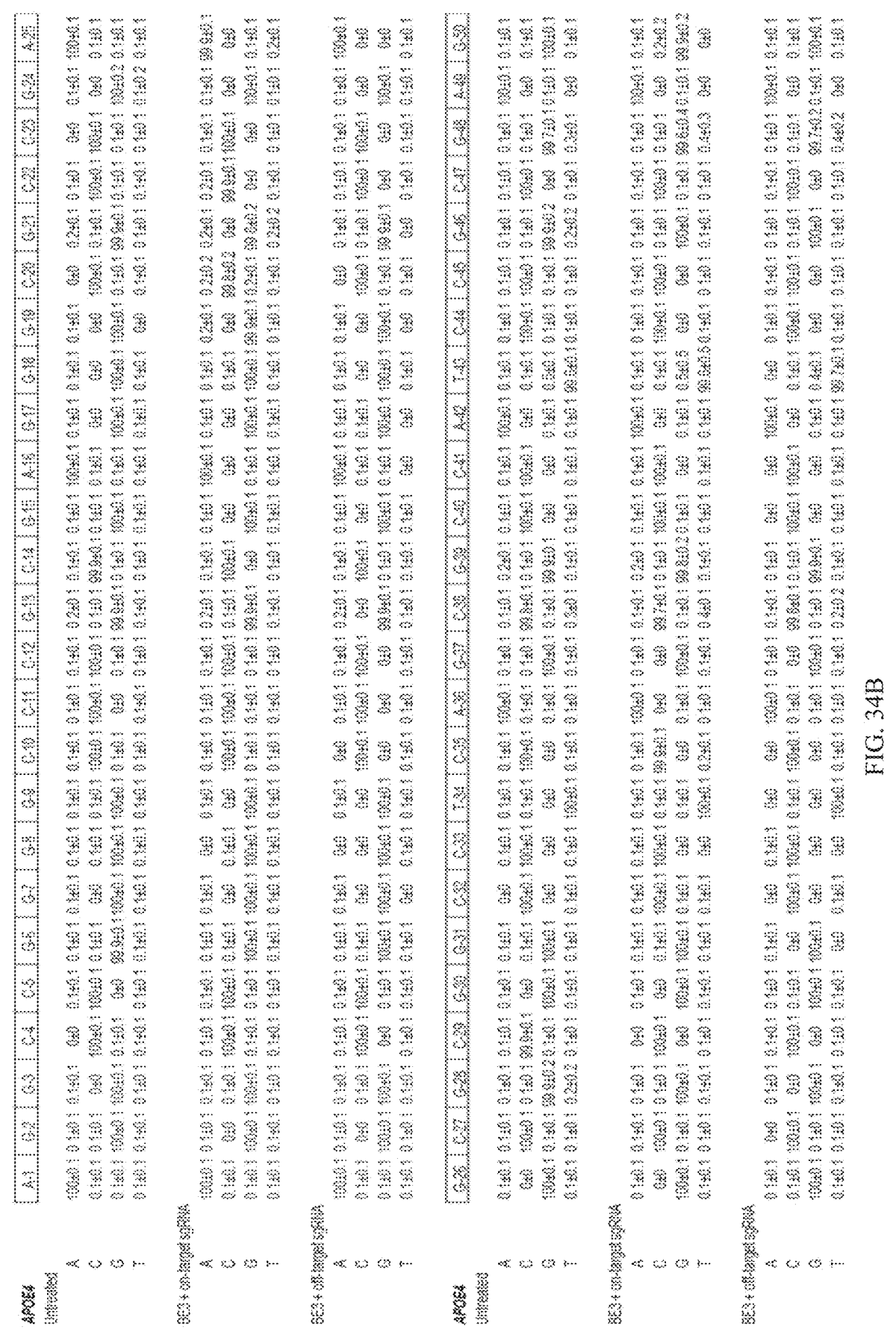

FIGS. 34A to 34B shows mutation rates of non-protospacer bases following BE3-mediated correction of the Alzheimer's disease-associated APOE4 allele to APOE3r in mouse astrocytes. The DNA sequence of the 50 bases on either side of the protospacer from FIG. 30A and FIG. 34B is shown with each base's position relative to the protospacer. The side of the protospacer distal to the PAM is designated with positive numbers, while the side that includes the PAM is designated with negative numbers, with the PAM. Underneath each sequence are the percentages of total DNA sequencing reads with the corresponding base for untreated cells, for cells treated with BE3 and an sgRNA targeting the APOE4 C158R mutation, or for cells treated with BE3 and an sgRNA targeting the VEGFA locus. Neither BE3-treated sample resulted in mutation rates above those of untreated controls. This figure depicts SEQ ID NOs: 685 to 688 from top to bottom, respectively.

Figure 35A:
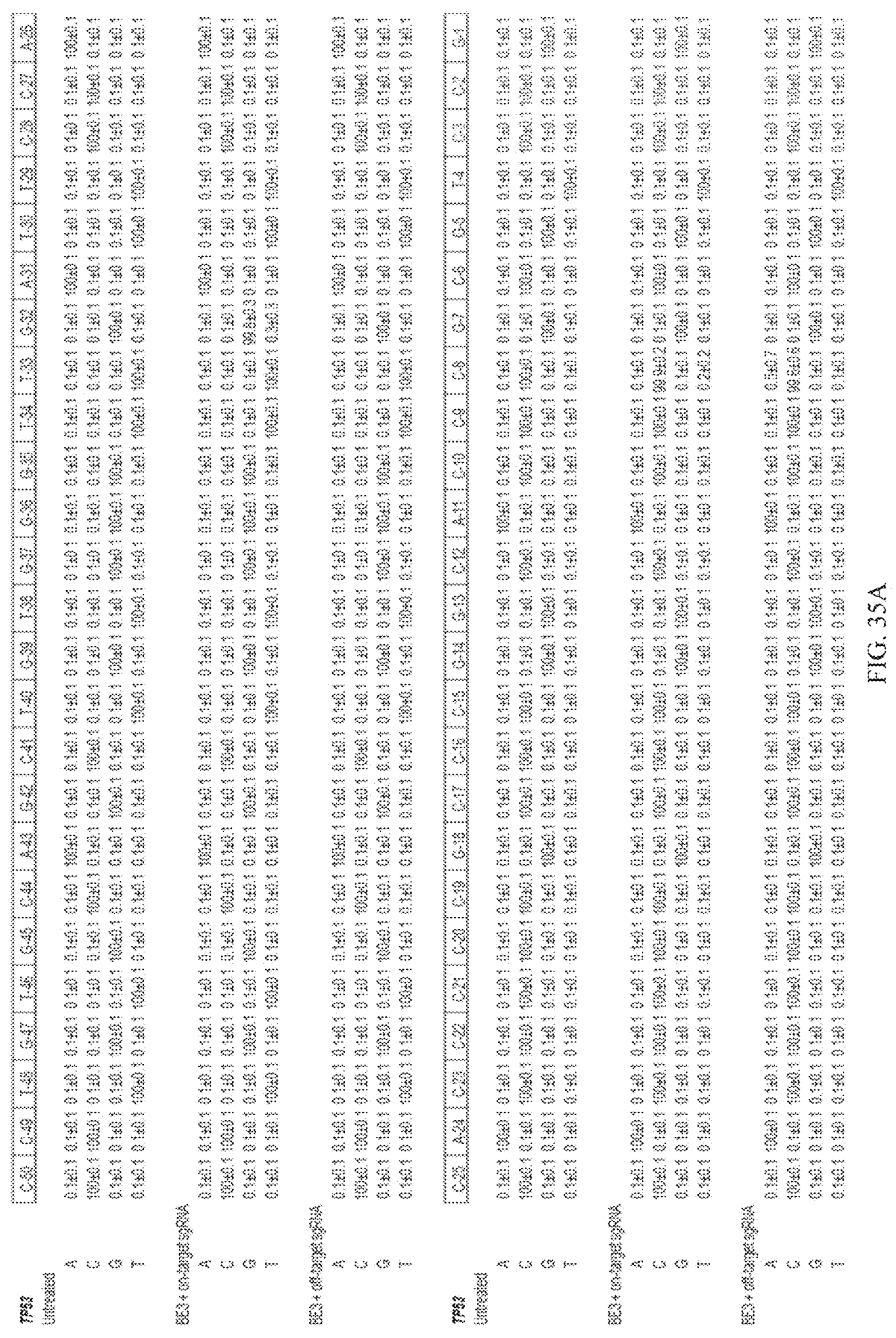
Figure 35B:
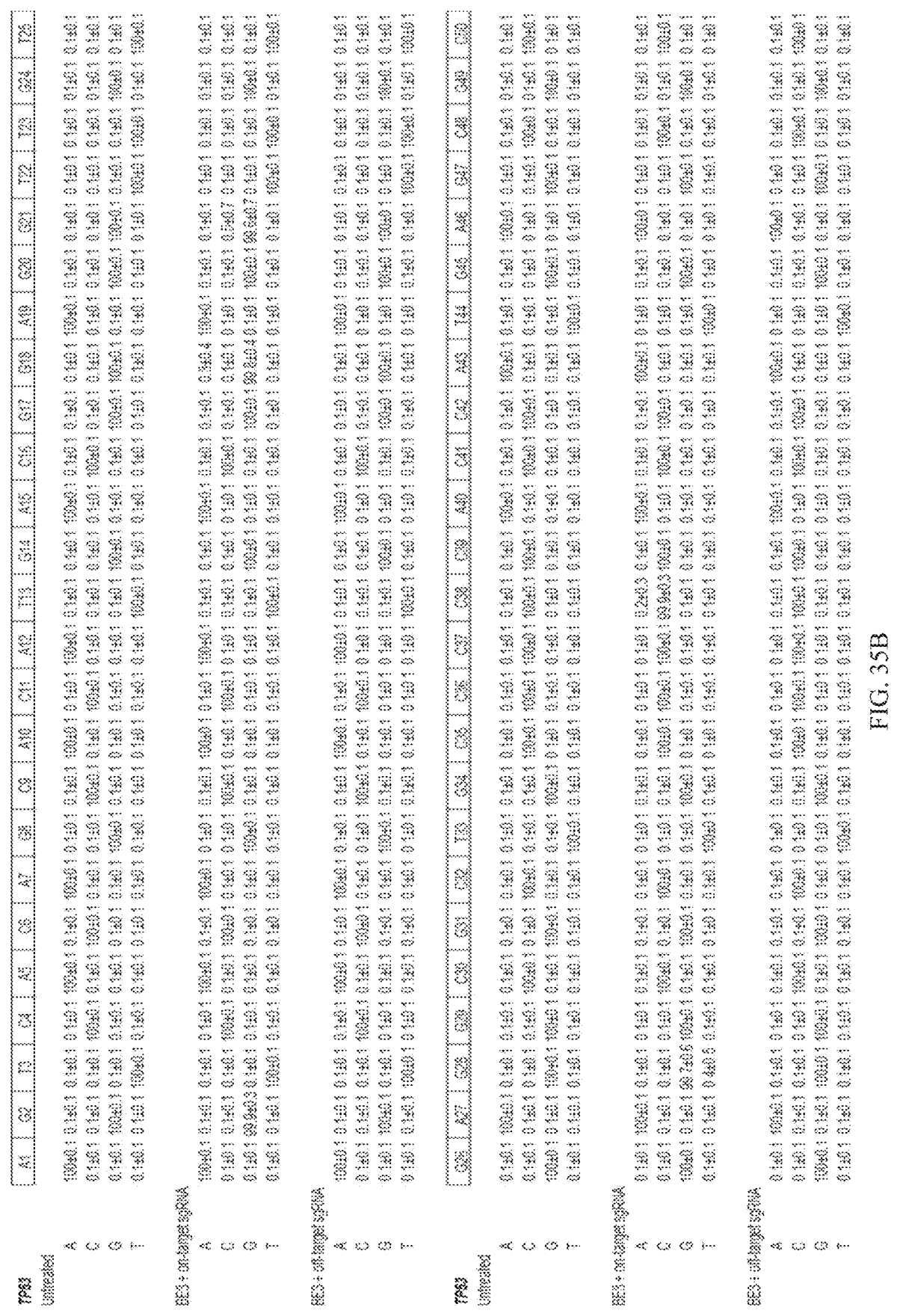

FIGS. 35A to 35B shows mutation rates of non-protospacer bases following BE3-mediated correction of the cancer-associated p53 Y163C mutation in HCC1954 human cells. The DNA sequence of the 50 bases on either side of the protospacer from FIG. 30B and FIG. 39B is shown with each base's position relative to the protospacer. The side of the protospacer distal to the PAM is designated with positive numbers, while the side that includes the PAM is designated with negative numbers, with the PAM. Underneath each sequence are the percentages of total sequencing reads with the corresponding base for untreated cells, for cells treated with BE3 and an sgRNA targeting the TP53 Y163C mutation, or for cells treated with BE3 and an sgRNA targeting the VEGFA locus. Neither BE3-treated sample resulted in mutational rates above those of untreated controls. This figure depicts SEQ ID NOs: 689 to 692 from top to bottom, respectively.

Figure 36A:
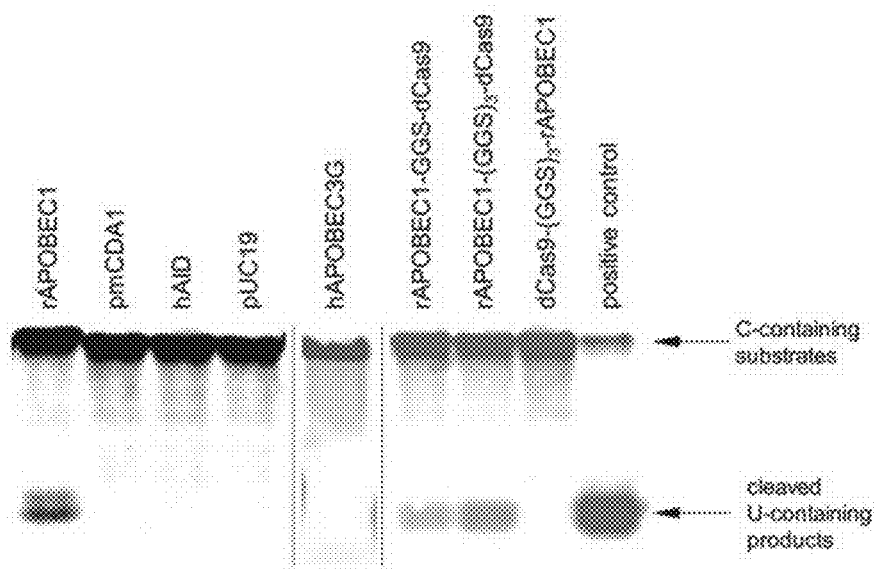
Figure 36B:
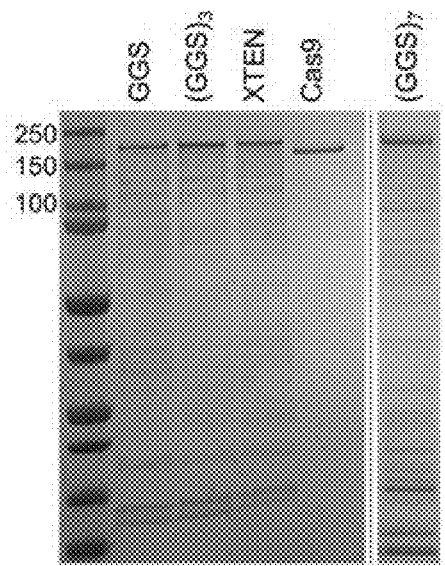
Figure 36C:
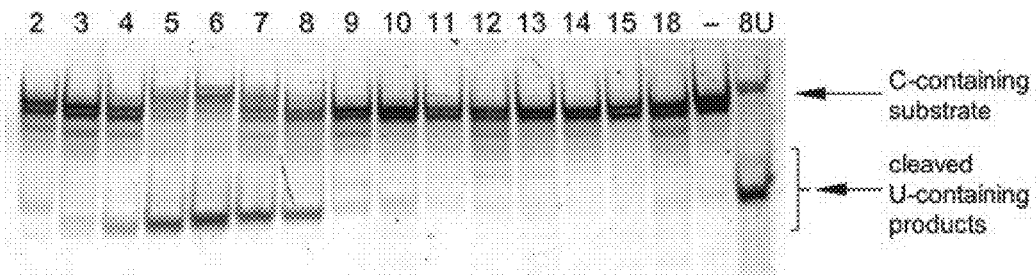

FIGS. 36A to 36F show the effects of deaminase, linker length, and linker composition on base editing. FIG. 36A shows a gel-based deaminase assay showing activity of rAPOBEC1, pmCDA1, hAID, hAPOBEC3G, rAPOBEC1-GGS-dCas9, rAPOBEC1-(GGS)$_3$(SEQ ID NO: 610)-dCas9, and dCas9-(GGS)$_3$(SEQ ID NO: 610)-rAPOBEC1 on ssDNA. Enzymes were expressed in a mammalian cell lysate-derived in vitro transcription-translation system and incubated with 1.8 µM dye-conjugated ssDNA and USER enzyme (uracil DNA glycosylase and endonuclease VIII) at 37° C. for 2 hours. The resulting DNA was resolved on a denaturing polyacrylamide gel and imaged. The positive control is a sequence with a U synthetically incorporated at the same position as the target C. FIG. 36B shows coomassie-stained denaturing PAGE gel of the expressed and purified proteins used in FIGS. 36C to 36F. FIGS. 36C to 36F show gel-based deaminase assay showing the deamination window of base editors with deaminase-Cas9 linkers of GGS (FIG. 36C), (GGS)$_3$ (SEQ ID NO: 610) (FIG. 36D), XTEN (FIG. 36E), or (GGS)$_7$ (SEQ ID NO: 610) (FIG. 36F). Following incubation of 1.85 µM deaminase-dCas9 fusions complexed with sgRNA with 125 nM dsDNA substrates at 37° C. for 2 hours, the dye-conjugated DNA was isolated and incubated with USER enzyme at 37° C. for 1 hour to cleave the DNA backbone at the site of any uracils. The resulting DNA was resolved on a denaturing polyacrylamide gel, and the dye-conjugated strand was imaged. Each lane is numbered according to the position of the target C within the protospacer, or with - if no target C is present. 8U is a positive control sequence with a U synthetically incorporated at position 8.

Figure 37B:
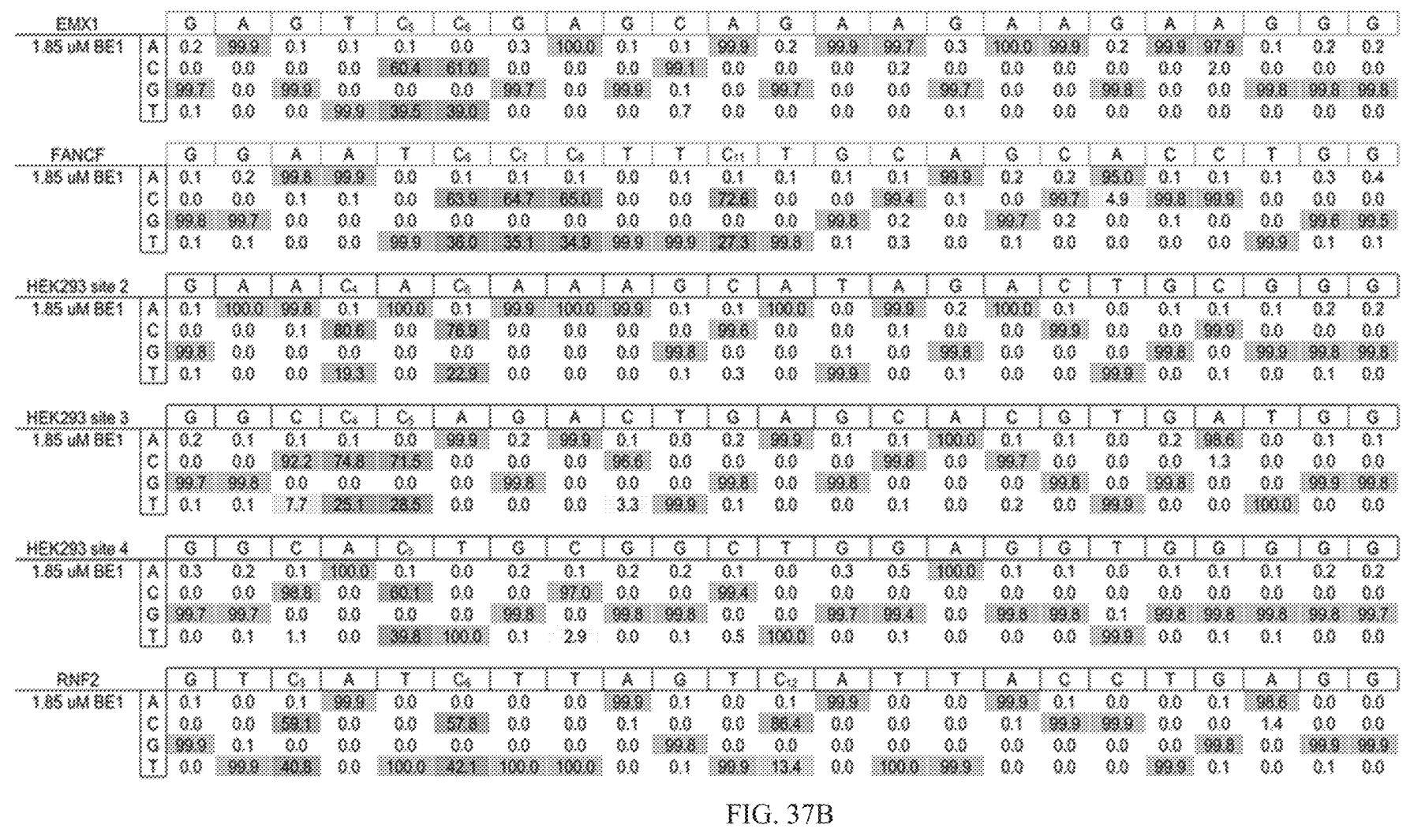
Figure 37C:

FIGS. 37A to 37C show BE1 base editing efficiencies are dramatically decreased in mammalian cells. FIG. 37A Protospacer and PAM sequences of the six mammalian cell genomic loci targeted by base editors. Target Cs are indicated in red with subscripted numbers corresponding to their positions within the protospacer. FIG. 37B shows synthetic 80-mers with sequences matching six different genomic sites were incubated with BE1 then analyzed for base editing by HTS. For each site, the sequence of the protospacer is indicated to the right of the name of the site, with the PAM. Underneath each sequence are the percentages of total DNA sequencing reads with the corresponding base. We considered a target C as "editable" if the in vitro conversion efficiency is >10%. Note that maximum yields are 50% of total DNA sequencing reads since the non-targeted strand is unaffected by BE1. Values are shown from a single experiment. FIG. 37C shows HEK293T cells were transfected with plasmids expressing BE1 and an appropriate sgRNA. Three days after transfection, genomic DNA was extracted and analyzed by high-throughput DNA sequencing at the six loci. Cellular C to T conversion percentages, defined as the percentage of total DNA sequencing reads with Ts at the target positions indicated, are shown for BE1 at all six genomic loci. Values and error bars of all data from HEK293T cells reflect the mean and standard deviation of three independent biological replicates performed on different days. FIG. 37A depicts SEQ ID NOs: 127 to 132 from top to bottom, respectively. FIG. 37B depicts SEQ ID NOs: 127 to 132 from top to bottom, respectively.

Figure 38:
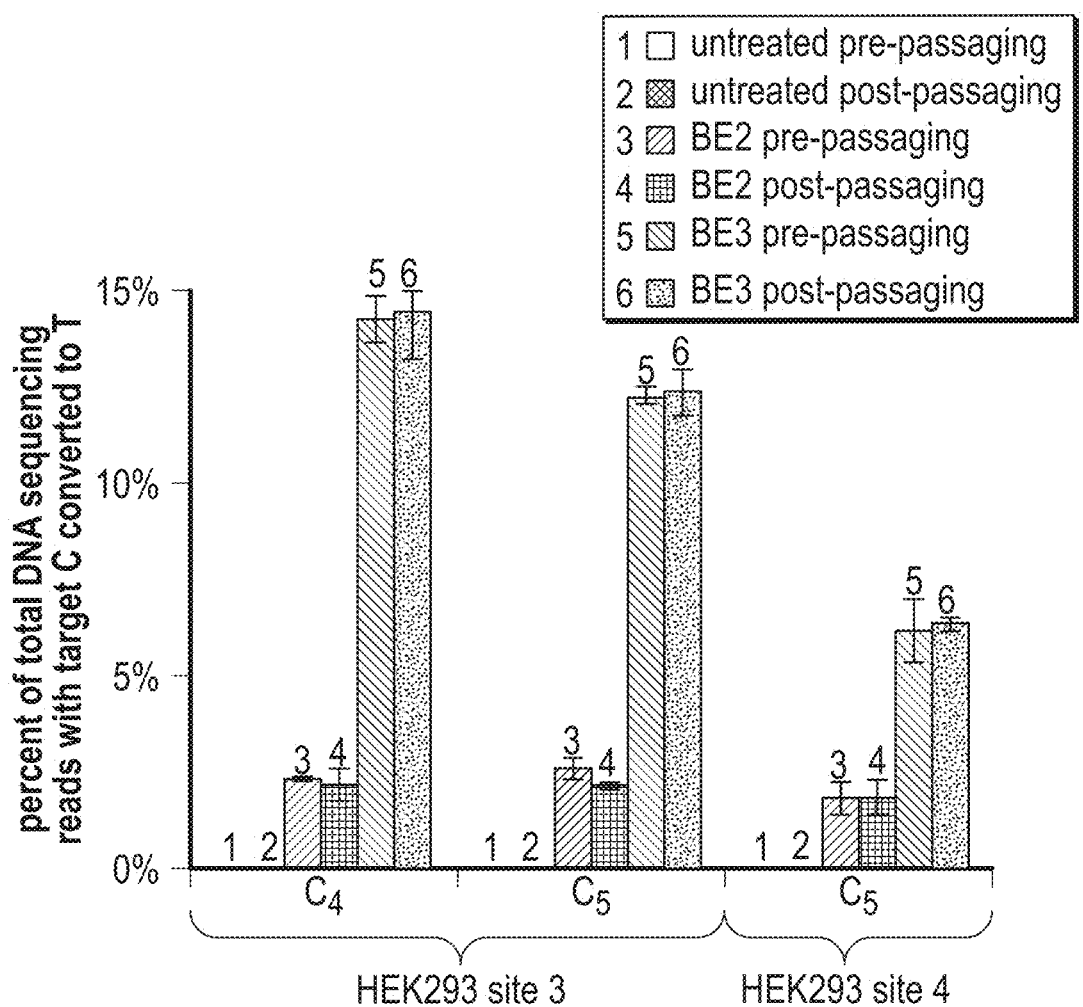

FIG. 38 shows base editing persists over multiple cell divisions. Cellular C to T conversion percentages by BE2 and BE3 are shown for HEK293 sites 3 and 4 in HEK293T cells before and after passaging the cells. HEK293T cells were nucleofected with plasmids expressing BE2 or BE3 and an sgRNA targeting HEK293 site 3 or 4. Three days after nucleofection, the cells were harvested and split in half. One half was subjected to HTS analysis, and the other half was allowed to propagate for approximately five cell divisions, then harvested and subjected to HTS analysis. Values and error bars reflect the mean and standard deviation of at least two biological experiments.

Figure 39A:
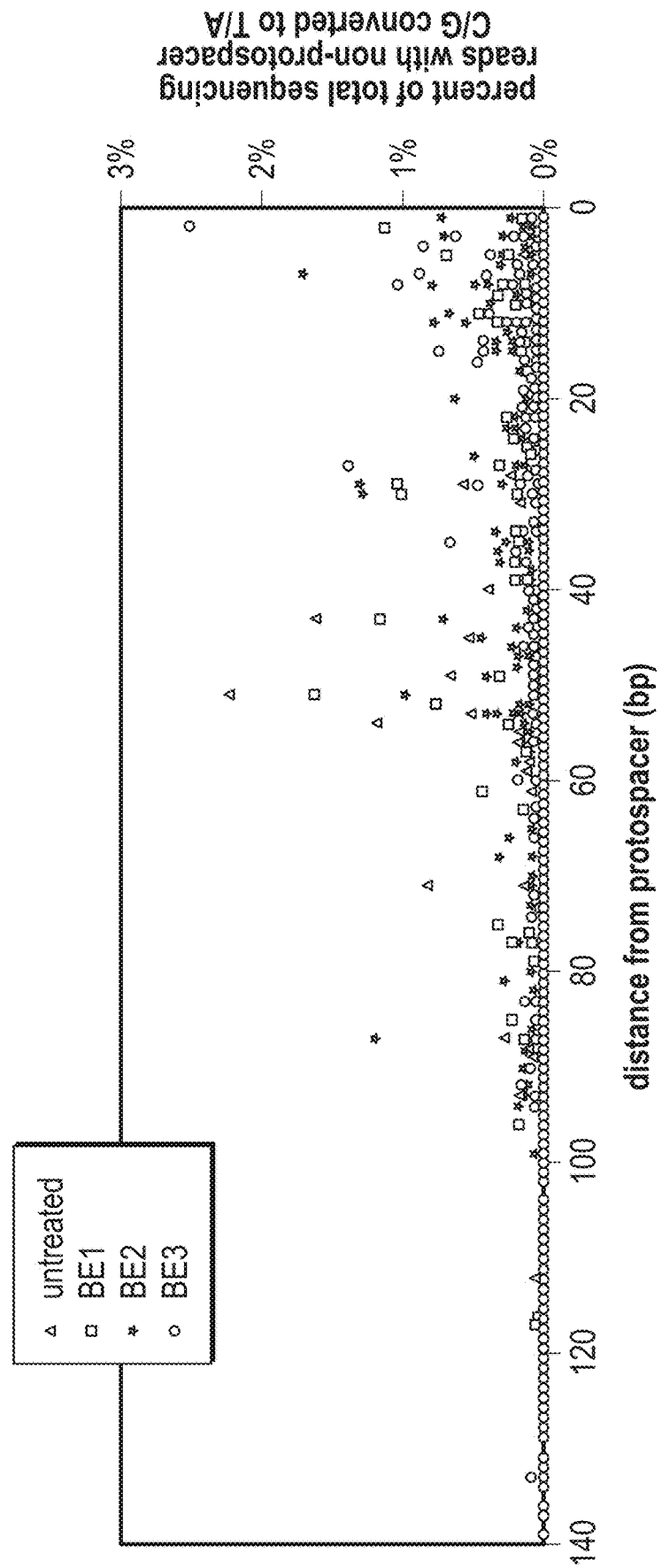
Figure 39B:
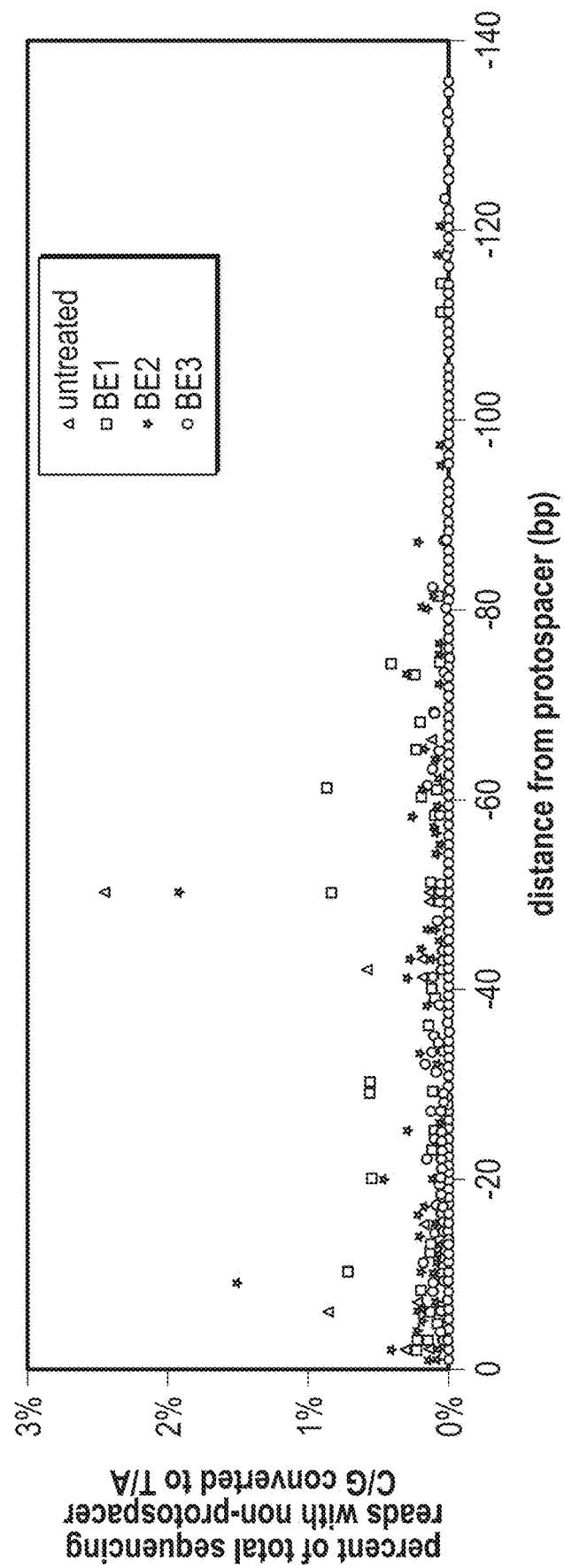

FIGS. 39A to 39C show non-target C/G mutation rates. Shown here are the C to T and G to A mutation rates at 2,500 distinct cytosines and guanines surrounding the six on-target and 34 off-target loci tested, representing a total of 14,700,000 sequence reads derived from approximately 1.8×10$^6$ cells. FIGS. 39A and 39B show cellular non-target C to T and G to A conversion percentages by BE1, BE2, and BE3 are plotted individually against their positions relative to a protospacer for all 2,500 cytosines/guanines. The side of the protospacer distal to the PAM is designated with positive numbers, while the side that includes the PAM is designated with negative numbers. FIG. 39C shows average non-target cellular C to T and G to A conversion percentages by BE1, BE2, and BE3 are shown, as well as the highest and lowest individual conversion percentages.

Figure 40A:
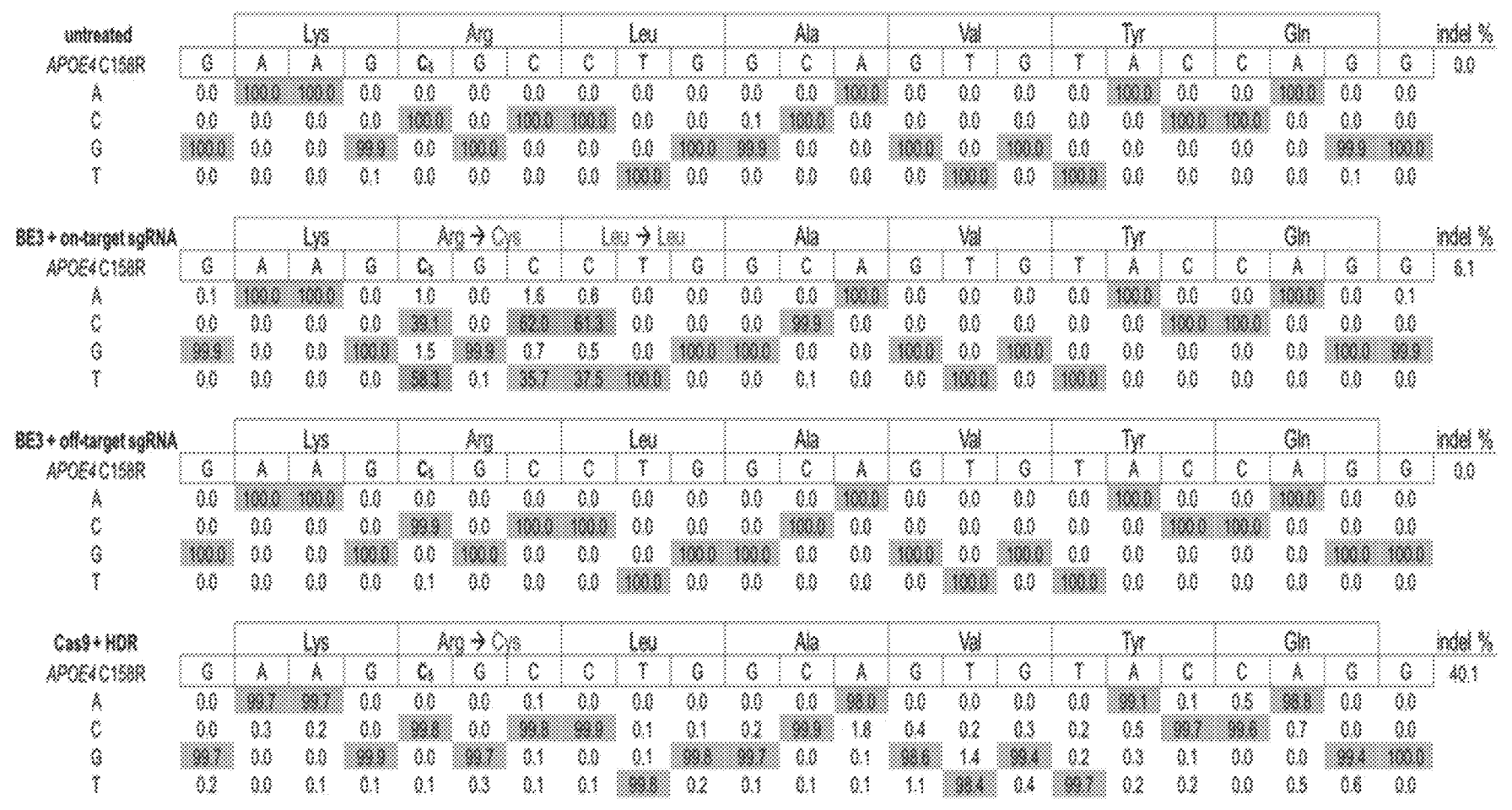
Figure 40B:
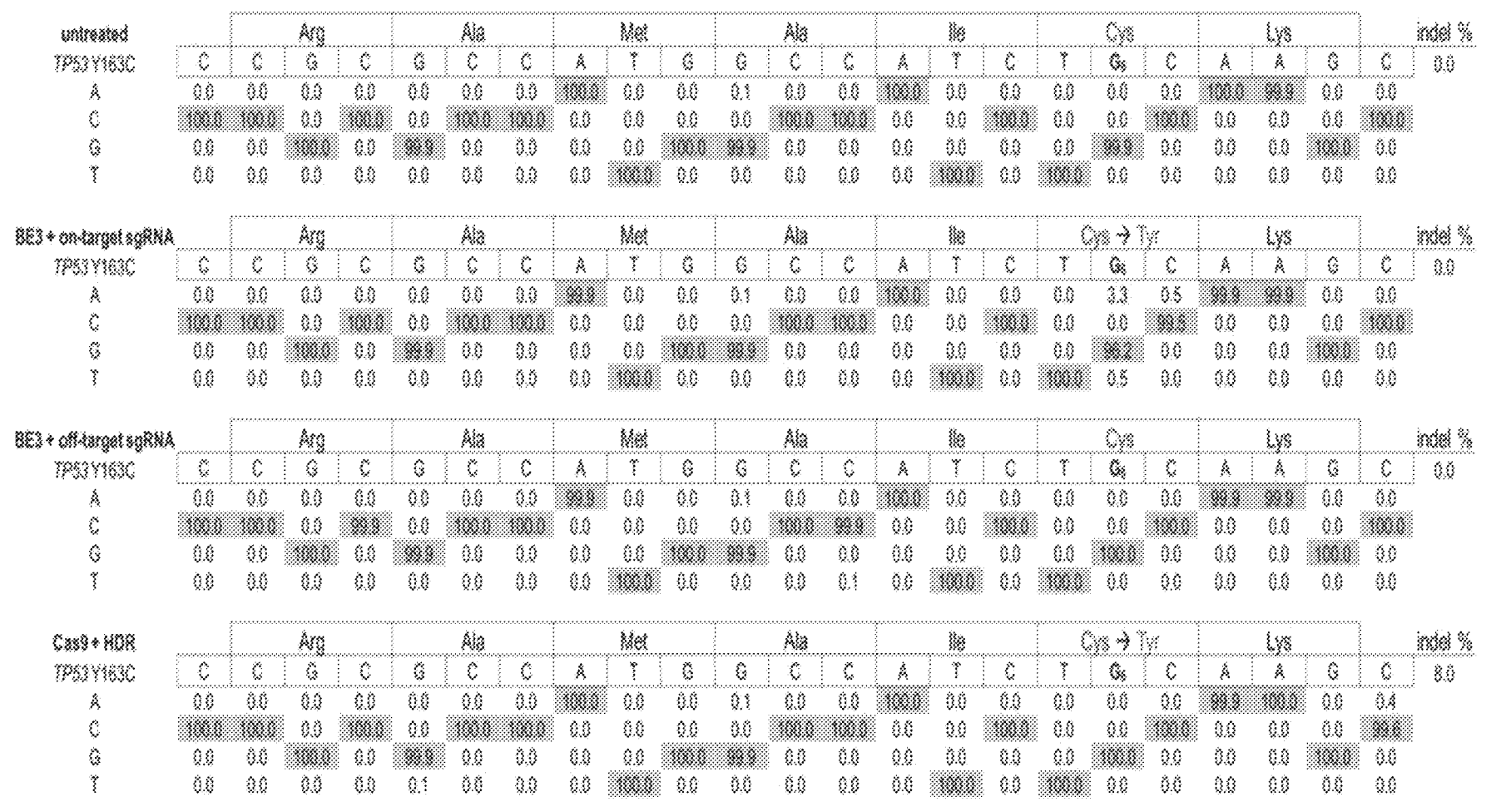

FIGS. 40A to 40B show additional data sets of BE3-mediated correction of two disease-relevant mutations in mammalian cells. For each site, the sequence of the protospacer is indicated to the right of the name of the mutation, with the PAM and the base responsible for the mutation indicated in red bold with a subscripted number corresponding to its position within the protospacer. The amino acid sequence above each disease-associated allele is shown, together with the corrected amino acid sequence following base editing. Underneath each sequence are the percentages of total sequencing reads with the corresponding base. Cells were nucleofected with plasmids encoding BE3 and an appropriate sgRNA. Two days after nucleofection, genomic DNA was extracted from the nucleofected cells and analyzed by HTS to assess pathogenic mutation correction. FIG. 40A shows the Alzheimer's disease-associated APOE4 allele is converted to APOE3r in mouse astrocytes by BE3 in 58.3% of total reads only when treated with the correct sgRNA. Two nearby Cs are also converted to Ts, but with no change to the predicted sequence of the resulting protein. Identical treatment of these cells with wt Cas9 and donor ssDNA results in 0.2% correction, with 26.7% indel formation. FIG. 40B shows the cancer-associated p53 Y163C mutation is corrected by BE3 in 3.3% of nucleofected human breast cancer cells only when treated with the correct sgRNA. Identical treatment of these cells with wt Cas9 and donor ssDNA results in no detectable mutation correction with 8.0% indel formation. FIGS. 40A to 40B depict SEQ ID NOs: 671, 627, 672 and 629.

Figure 41:
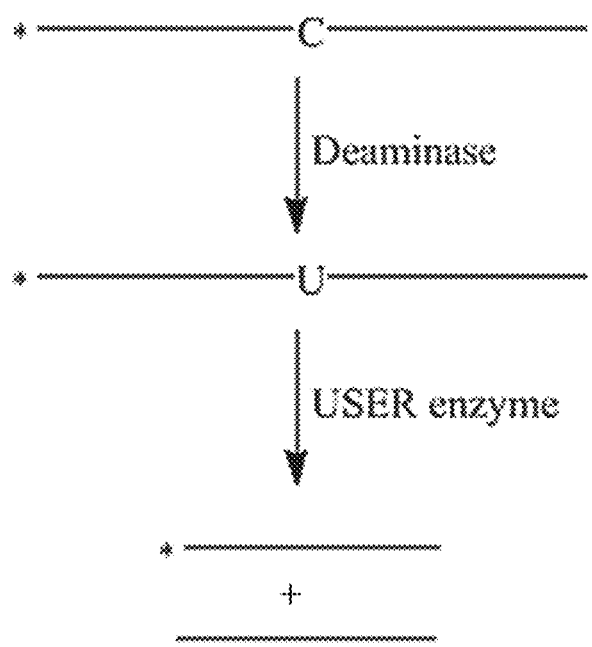

FIG. 41 shows a schematic representation of an exemplary USER (Uracil-Specific Excision Reagent) Enzyme-based assay, which may be used to test the activity of various deaminases on single-stranded DNA (ssDNA) substrates.

Figure 42:
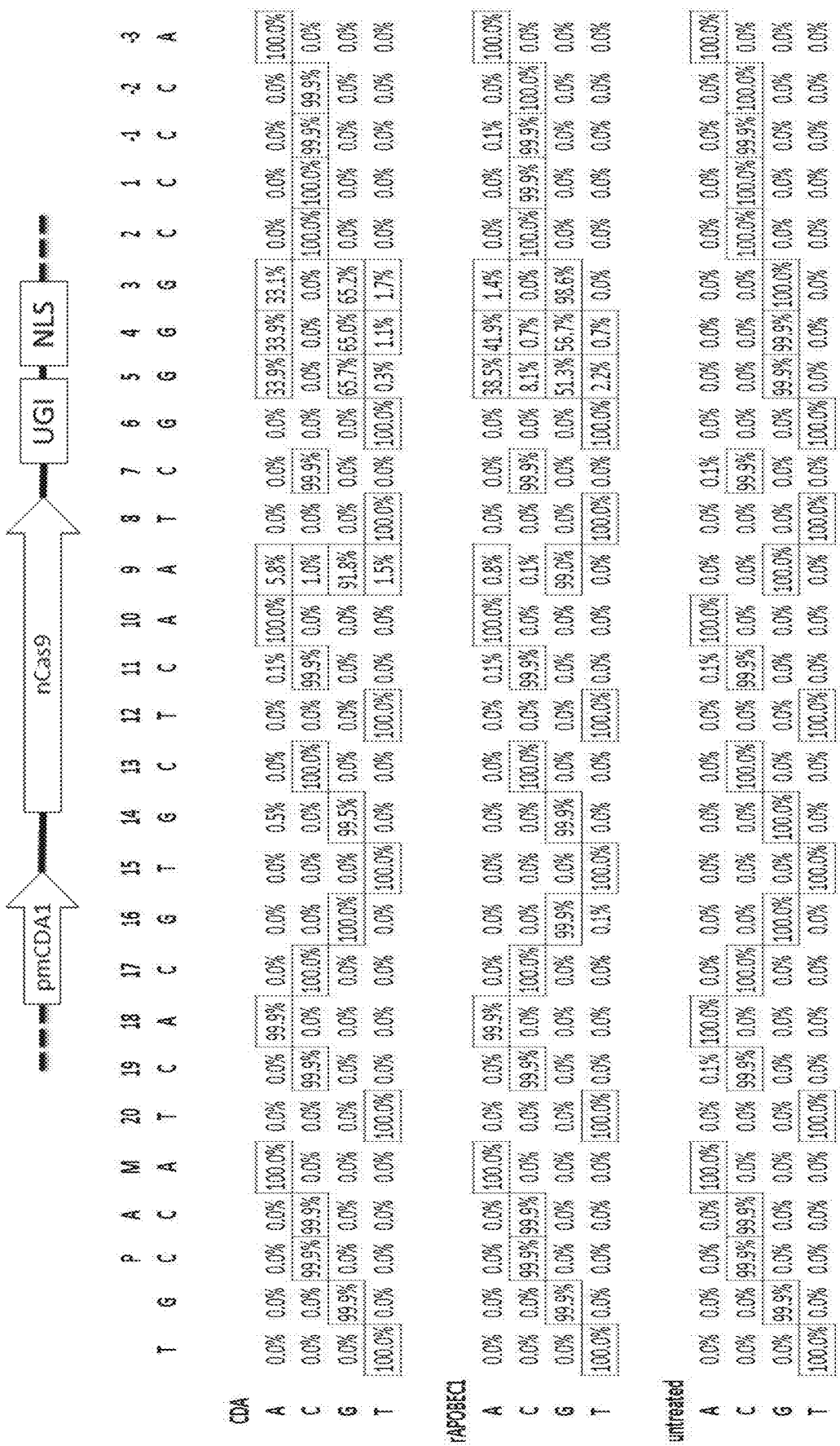

FIG. 42 is a schematic of the pmCDA-nCas9-UGI-NLS construct and its activity at the HeK-3 site relative to the base editor (rAPOBEC1) and the negative control (untreated). This figure depicts SEQ ID NO: 693.

Figure 43:
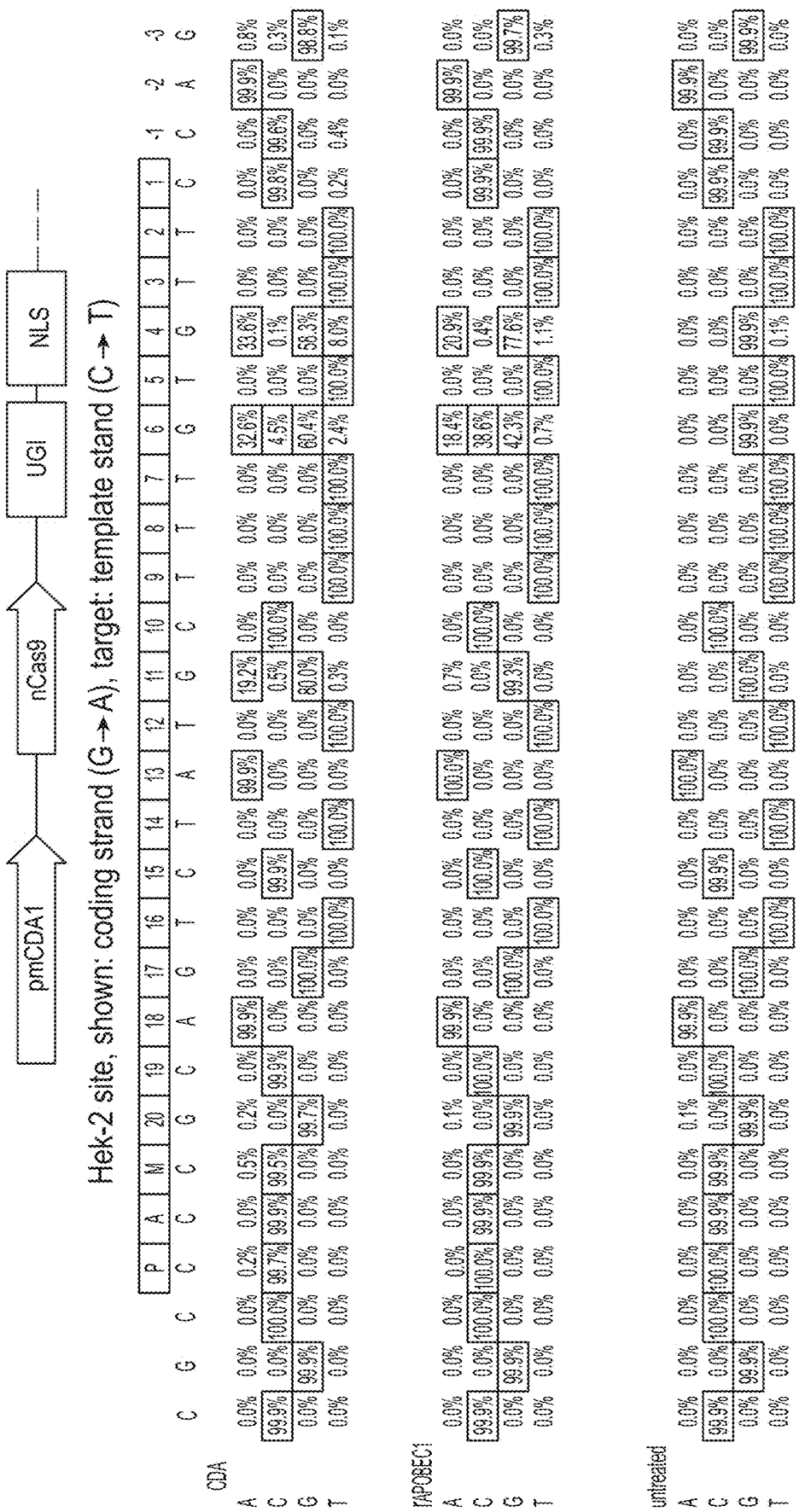

FIG. 43 is a schematic of the pmCDA1-XTEN-nCas9-UGI-NLS construct and its activity at the HeK-3 site relative to the base editor (rAPOBEC1) and the negative control (untreated). This figure depicts SEQ ID NO: 694.

Figure 44:
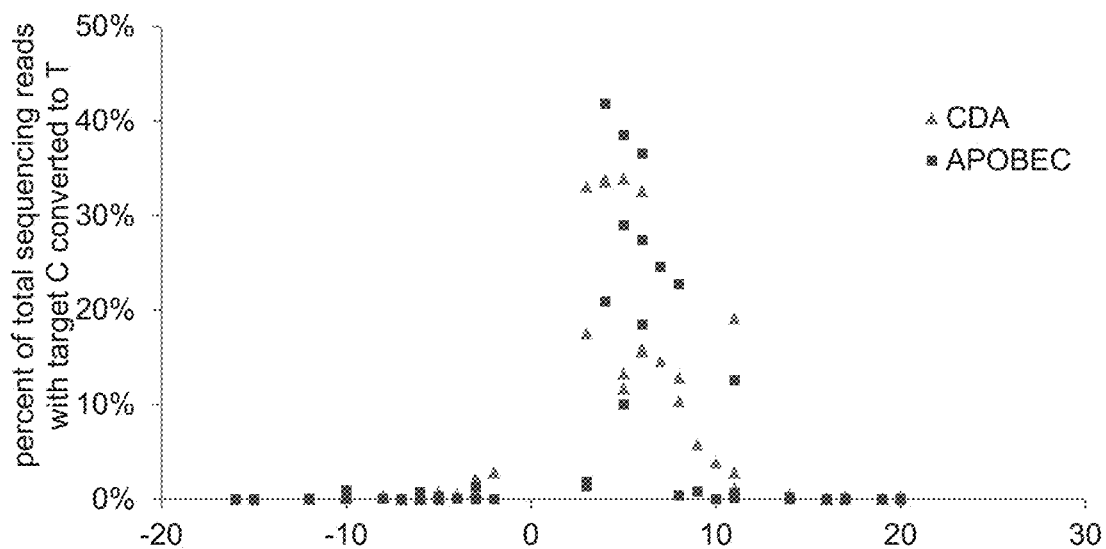

FIG. 44 shows the percent of total sequencing reads with target C converted to T using cytidine deaminases (CDA) or APOBEC.

Figure 45:
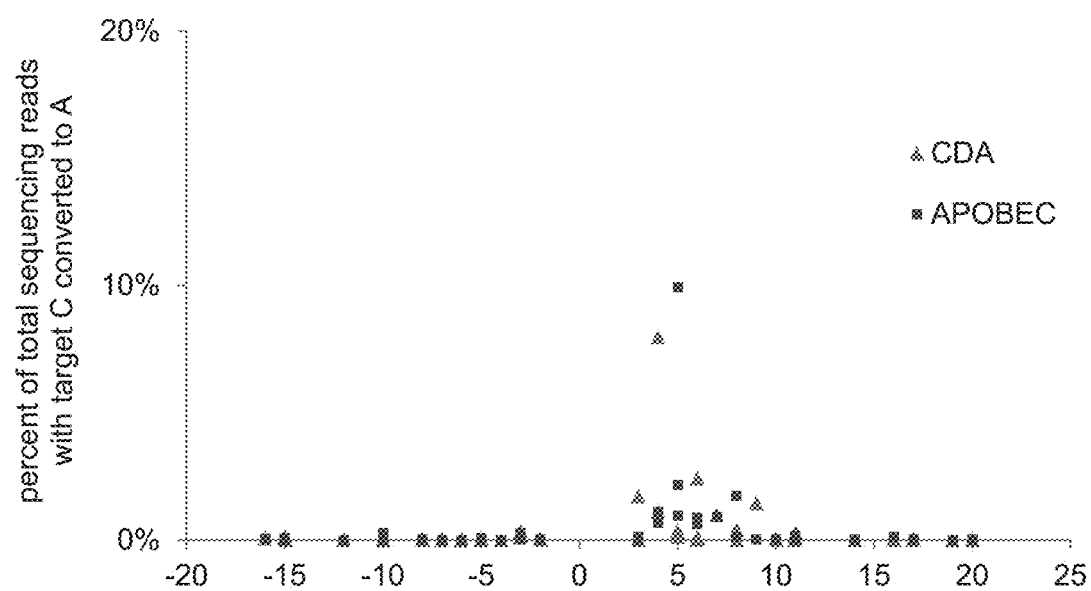

FIG. 45 shows the percent of total sequencing reads with target C converted to A using deaminases (CDA) or APOBEC.

Figure 46:
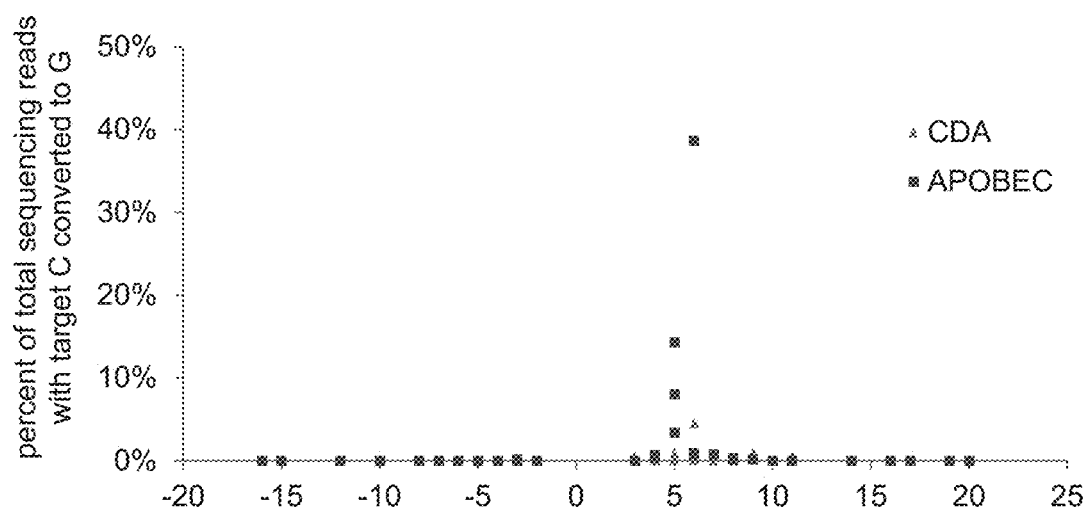

FIG. 46 shows the percent of total sequencing reads with target C converted to G using deaminases (CDA) or APOBEC.

Figure 47:
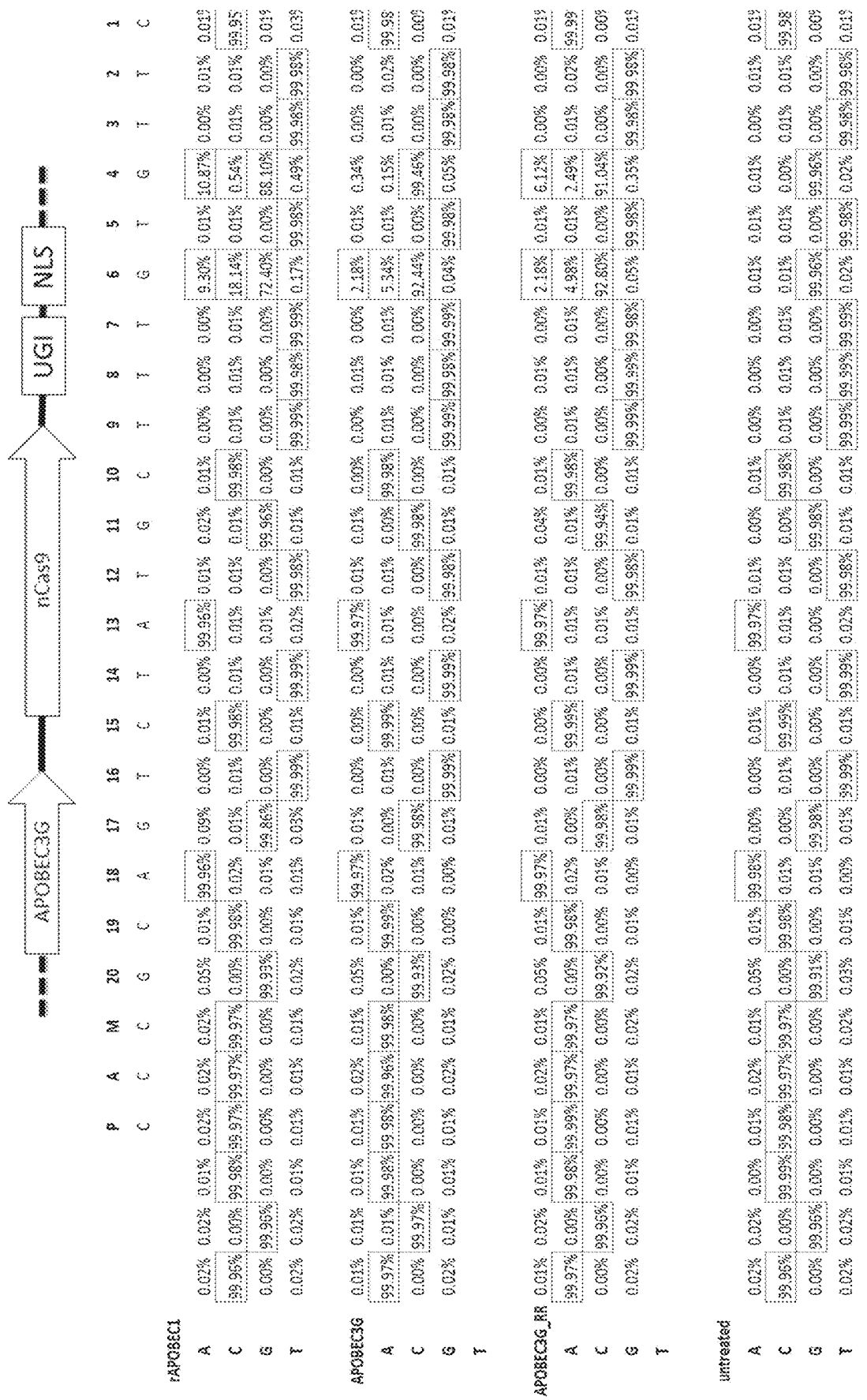

FIG. 47 is a schematic of the huAPOBEC3G-XTEN-nCas9-UGI-NLS construct and its activity at the HeK-2 site relative to a mutated form (huAPOBEC3G*(D316R_D317R)-XTEN-nCas9-UGI-NLS, the base editor (rAPOBEC1) and the negative control (untreated). This figure depicts SEQ ID NO: 695.

Figure 48:
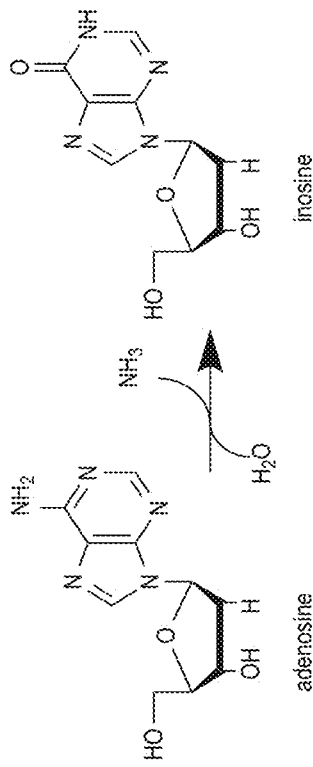

FIG. 48 shows the schematic of the LacZ construct used in the selection assay of Example 7.

Figure 49B:
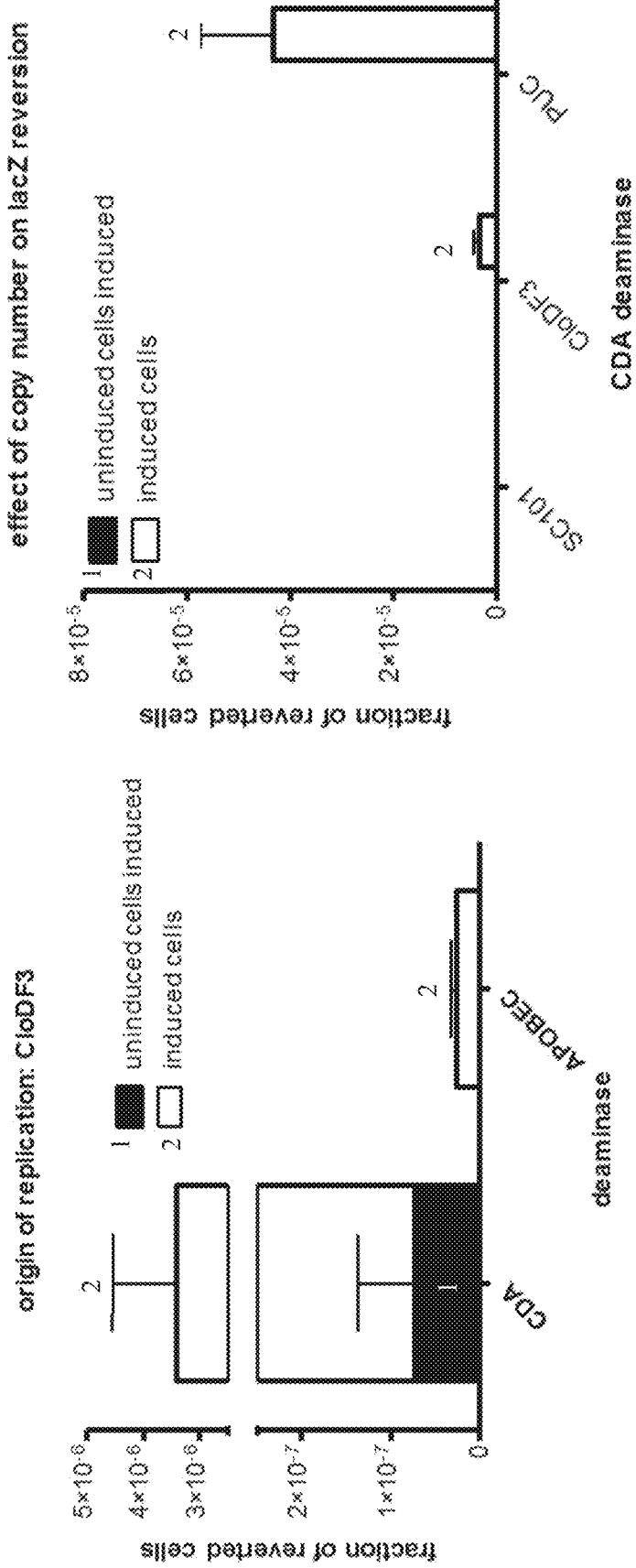

FIGS. 49A to 49B shows reversion data from different plasmids and constructs.

Figure 50:
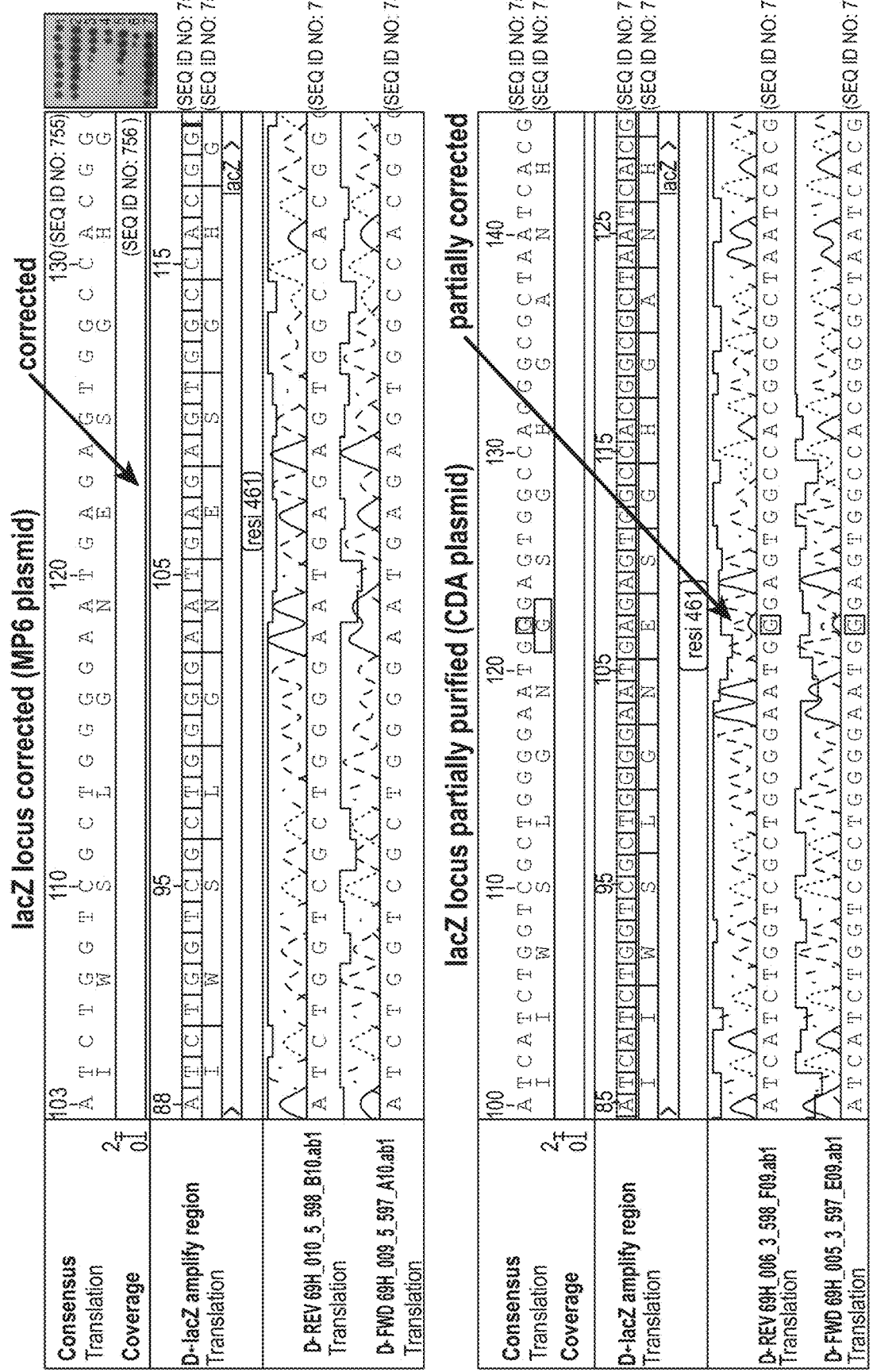

FIG. 50 shows the verification of lacZ reversion and the purification of reverted clones.

Figure 51:
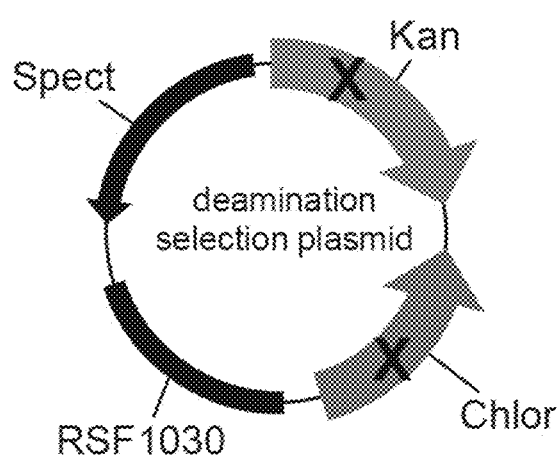

FIG. 51 is a schematic depicting a deamination selection plasmid used in Example 7.

Figure 52:
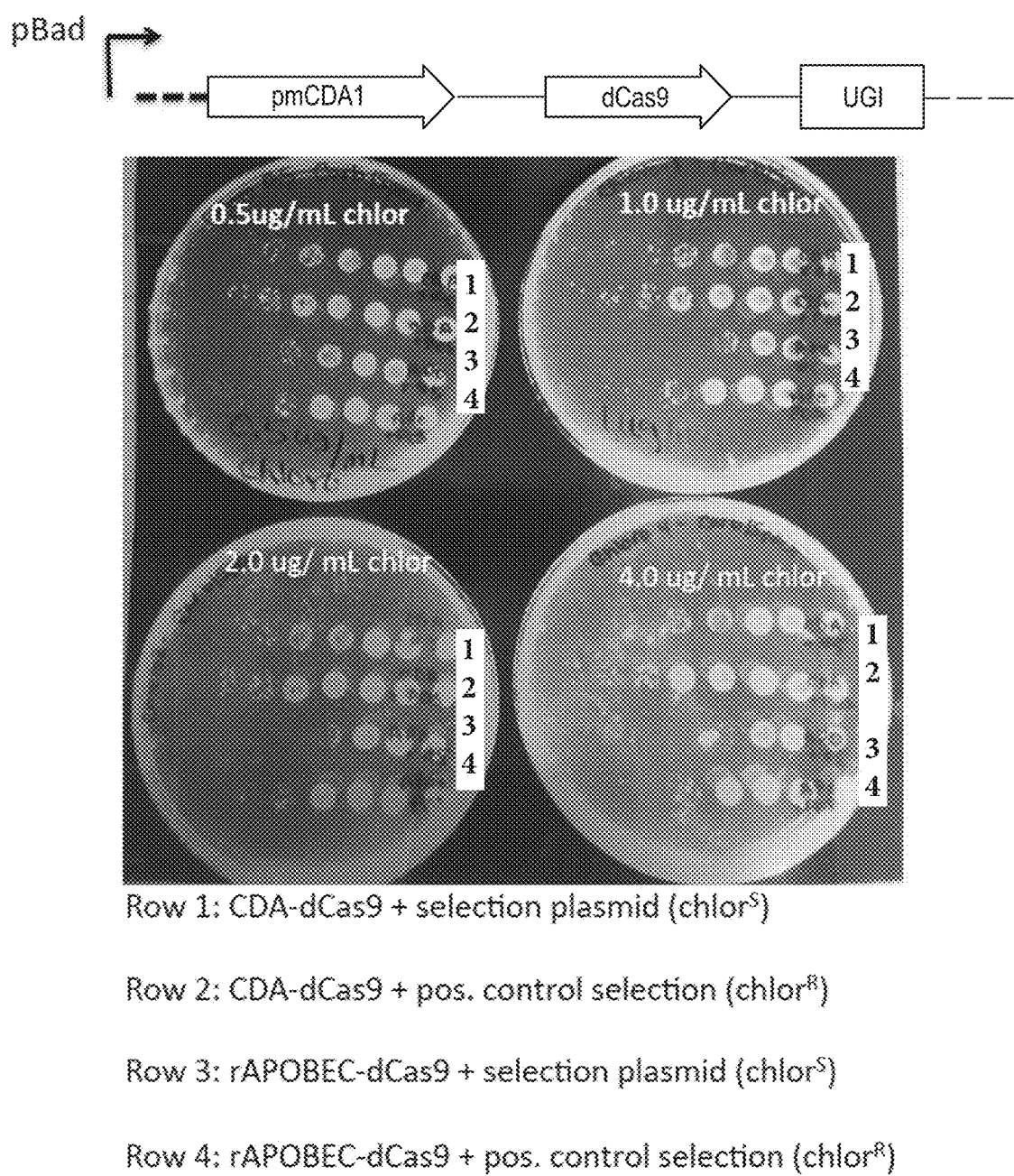

FIG. 52 shows the results of a chloramphenicol reversion assay (pmCDA1 fusion).

Figure 53A:
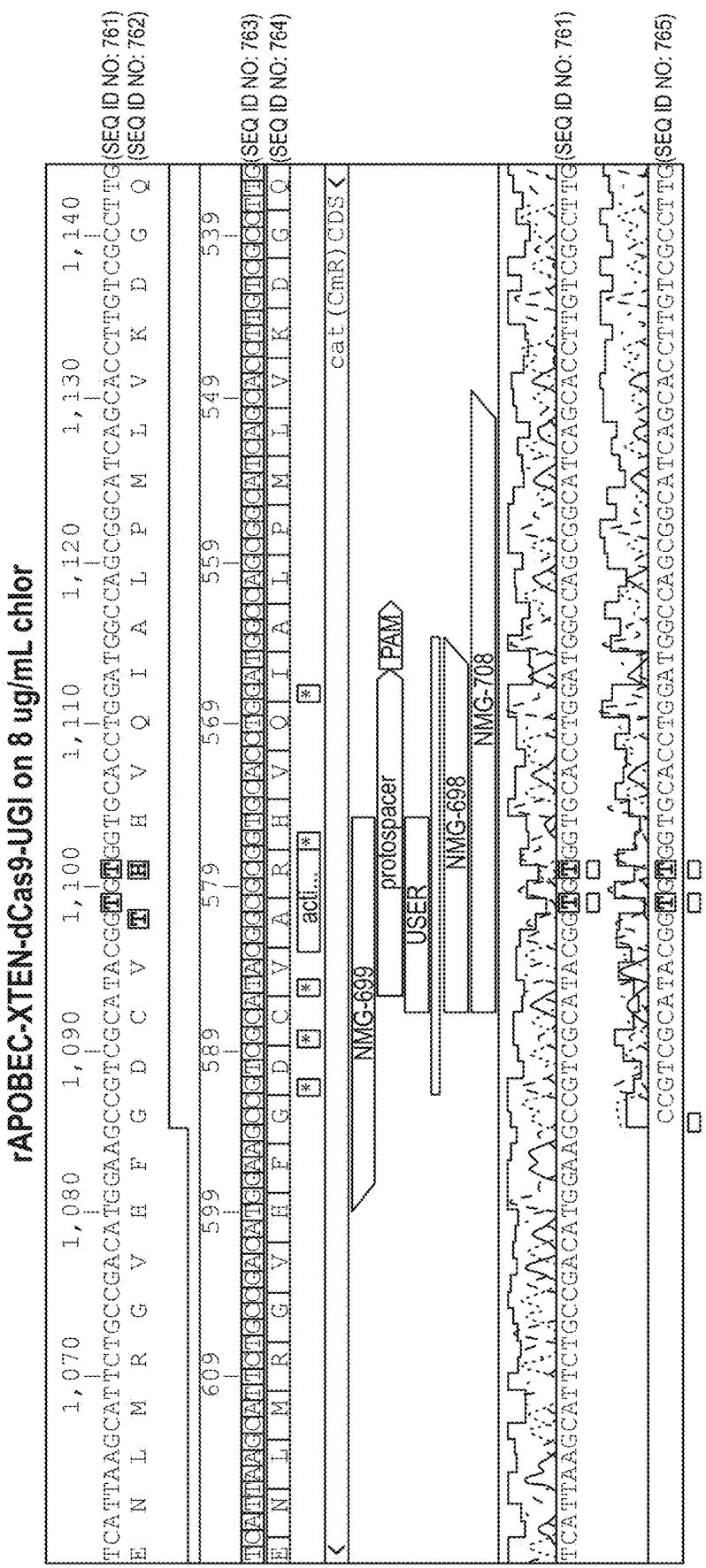
Figure 53B:
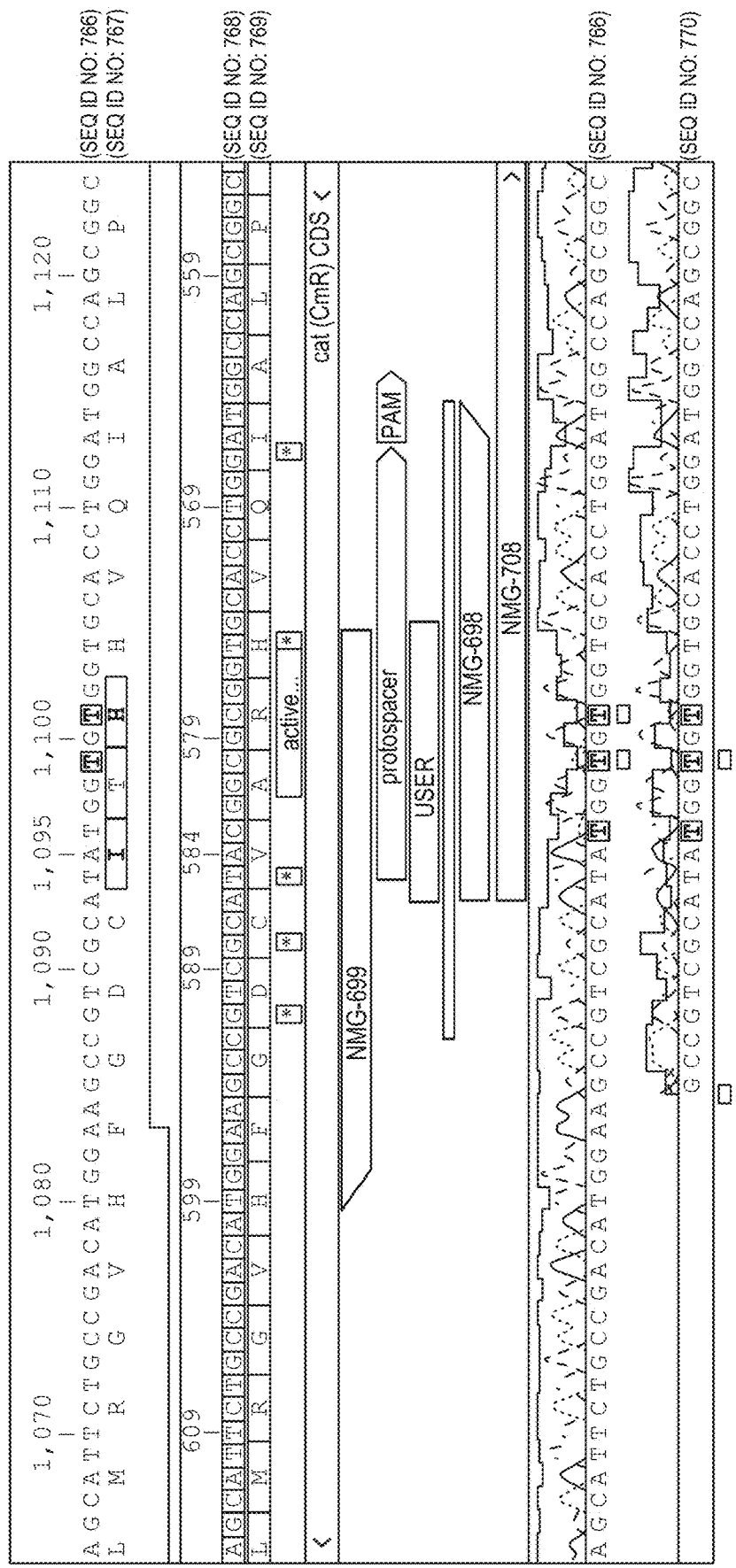

FIGS. 53A to 53B demonstrated DNA correction induction of two constructs.

Figure 54:
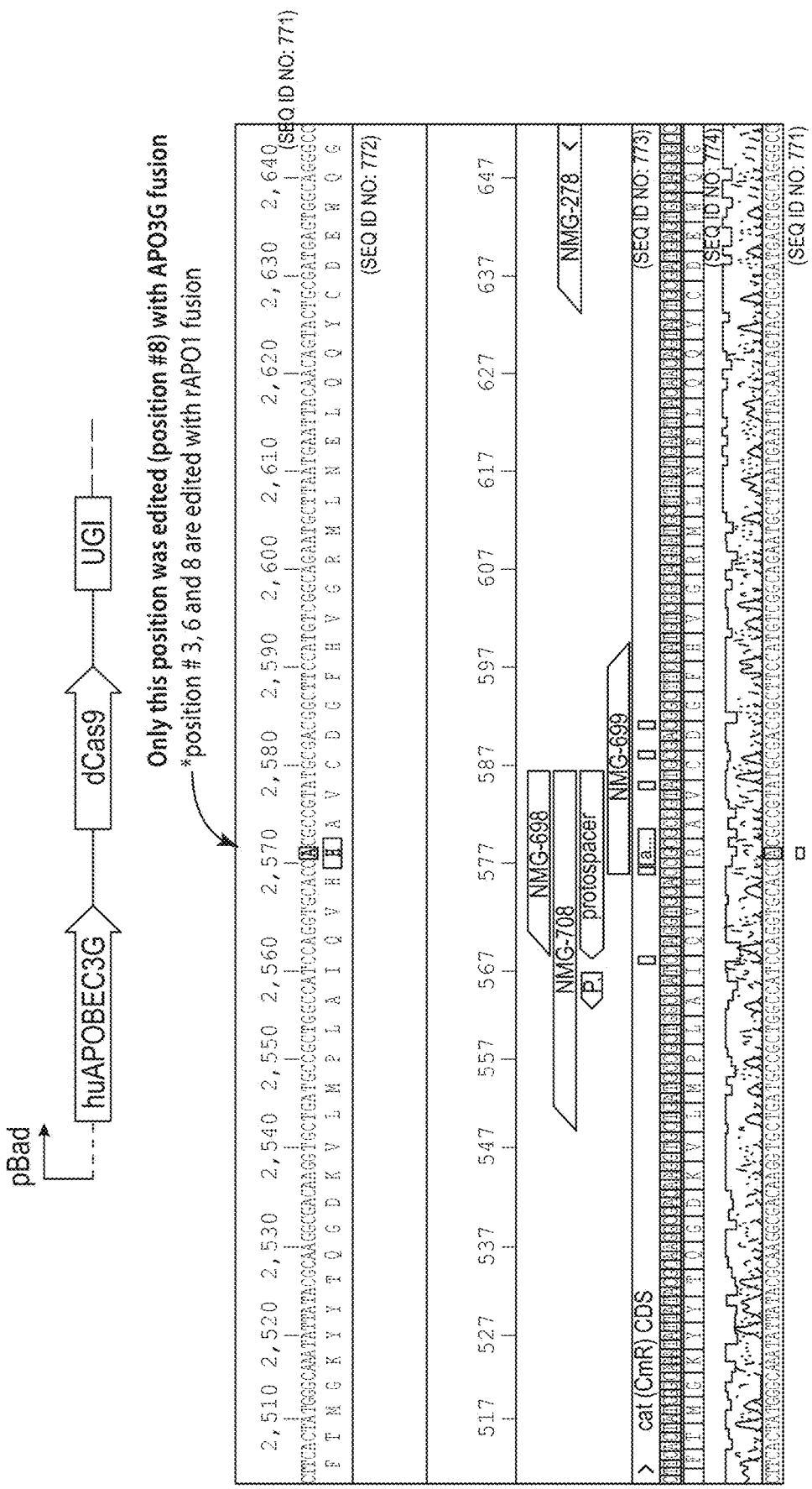

FIG. 54 shows the results of a chloramphenicol reversion assay (huAPOBEC3G fusion).

Figure 55A:
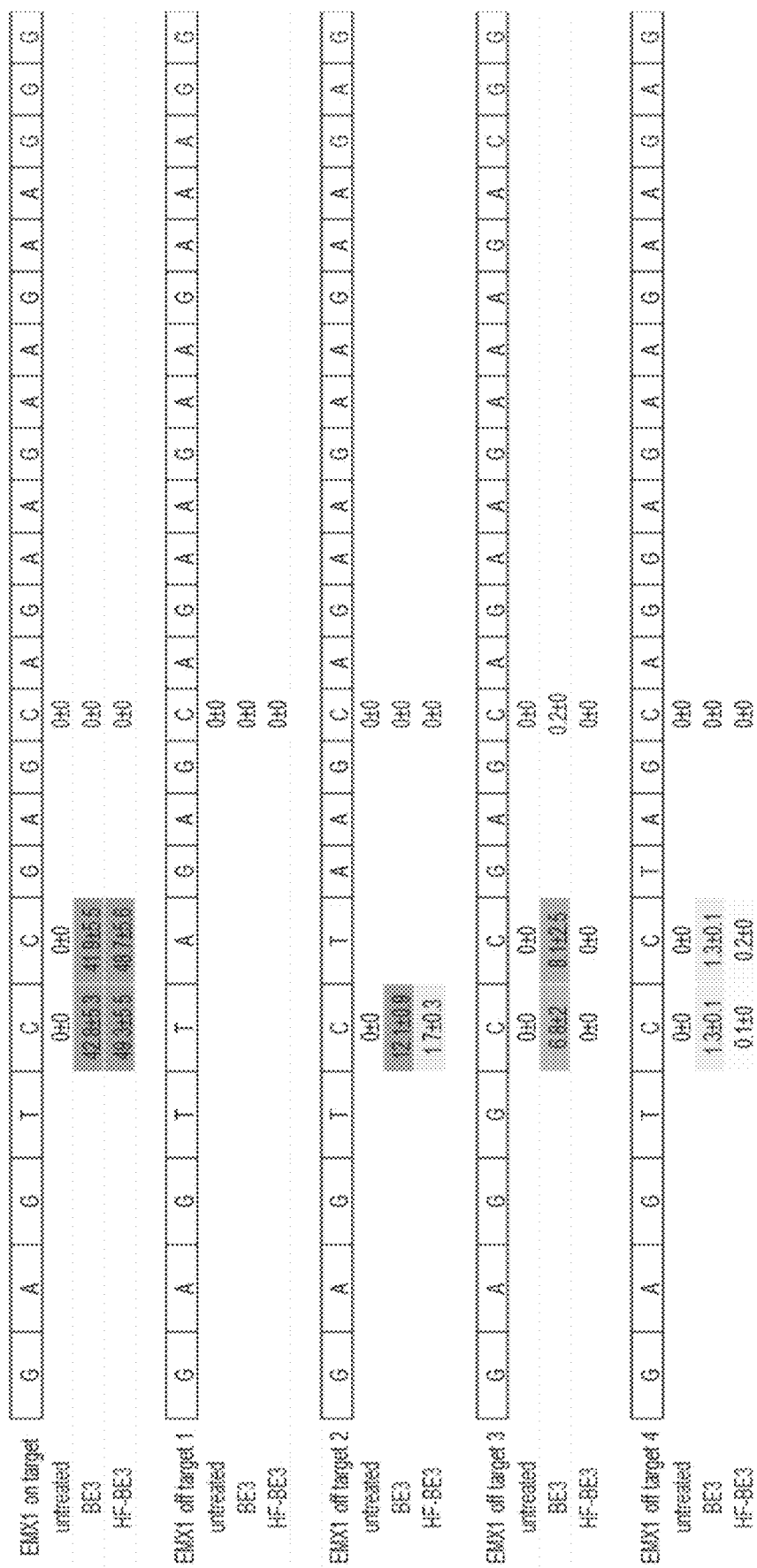
Figure 55B:
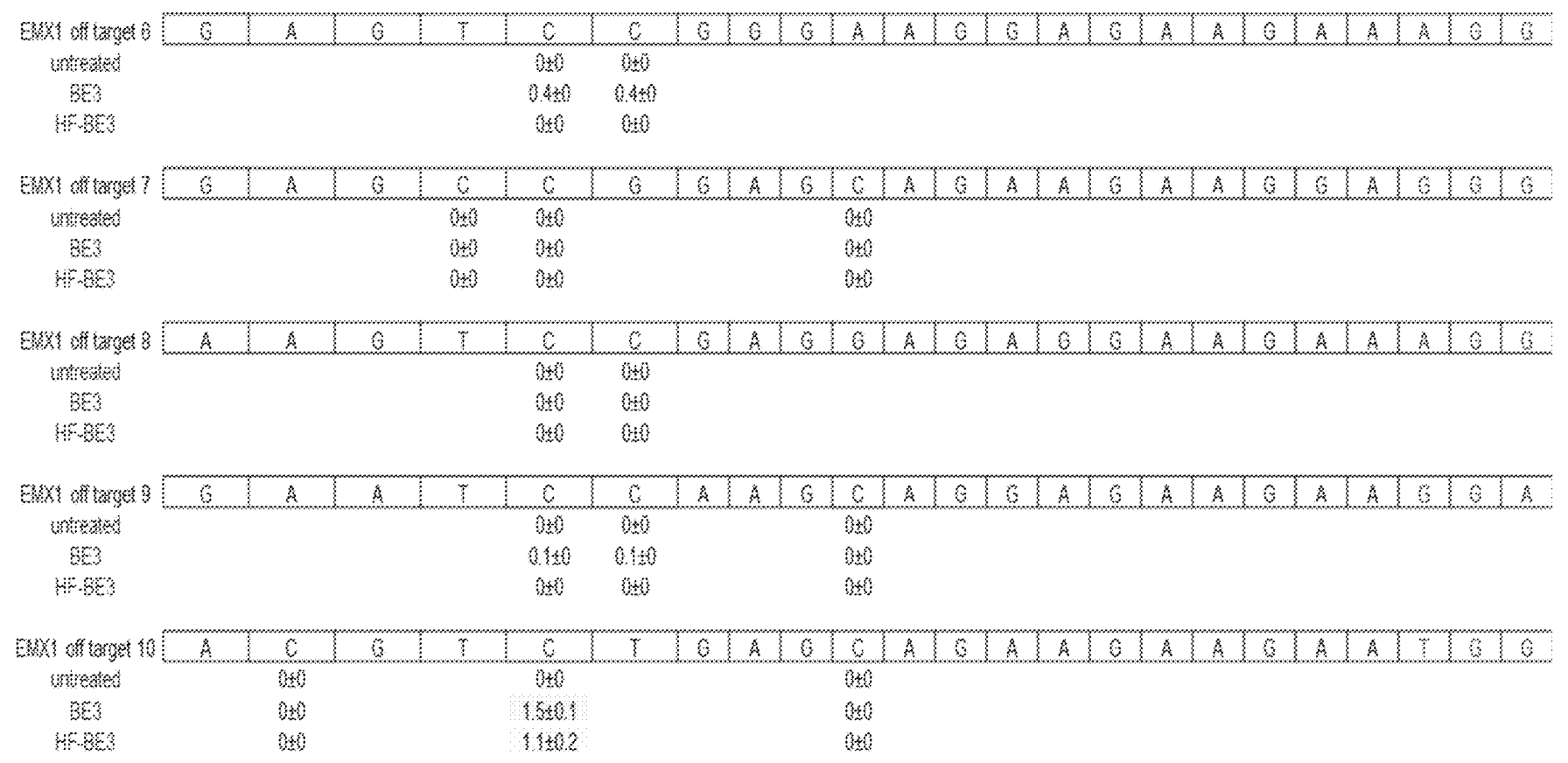

FIGS. 55A to 55B shows the activities of BE3 and HF-BE3 at EMX1 off-targets. The sequences, from top to bottom, correspond to SEQ ID NOs: 127 and 637-645.

Figure 56:
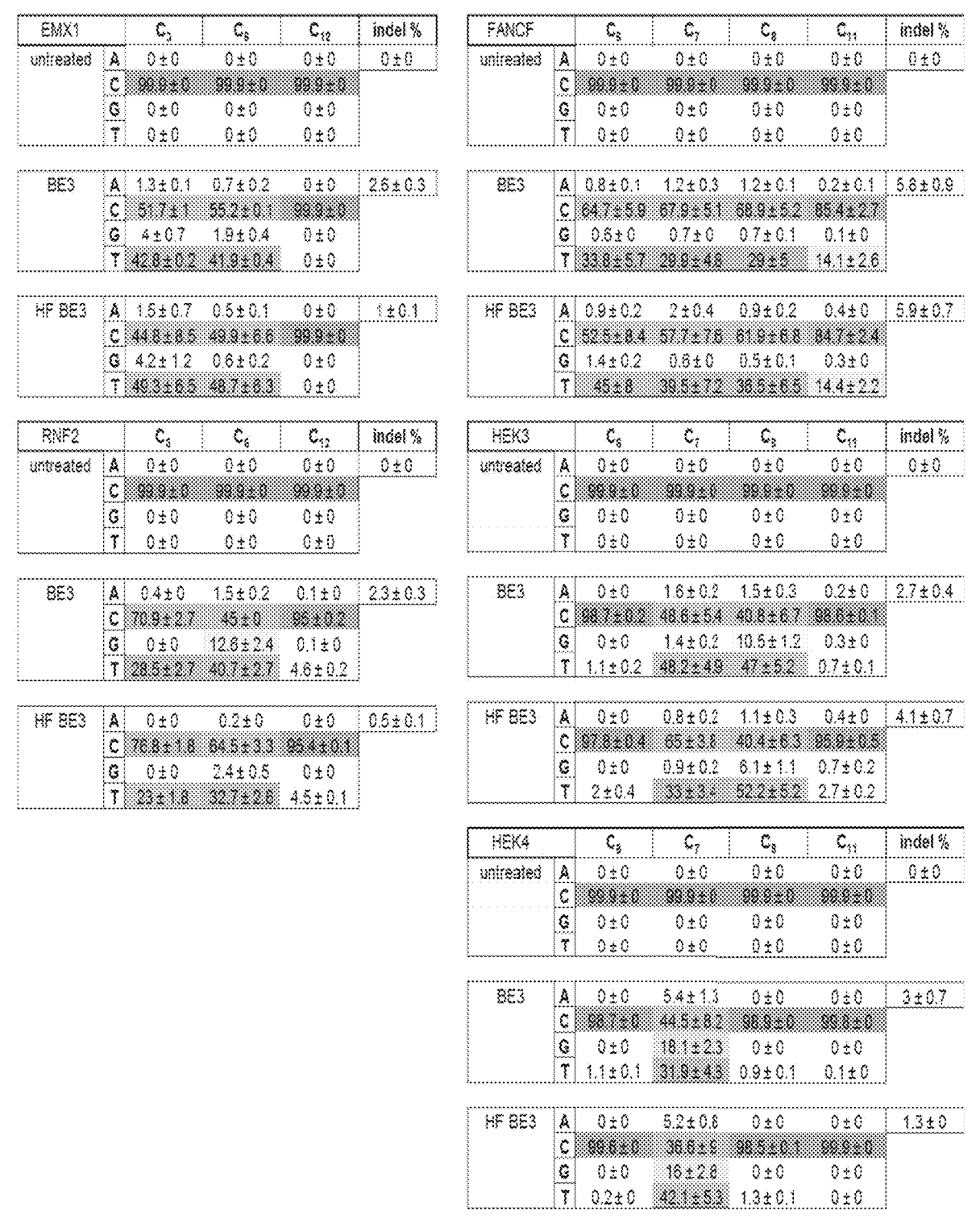

FIG. 56 shows on-target base editing efficiencies of BE3 and HF-BE3.

Figure 57:
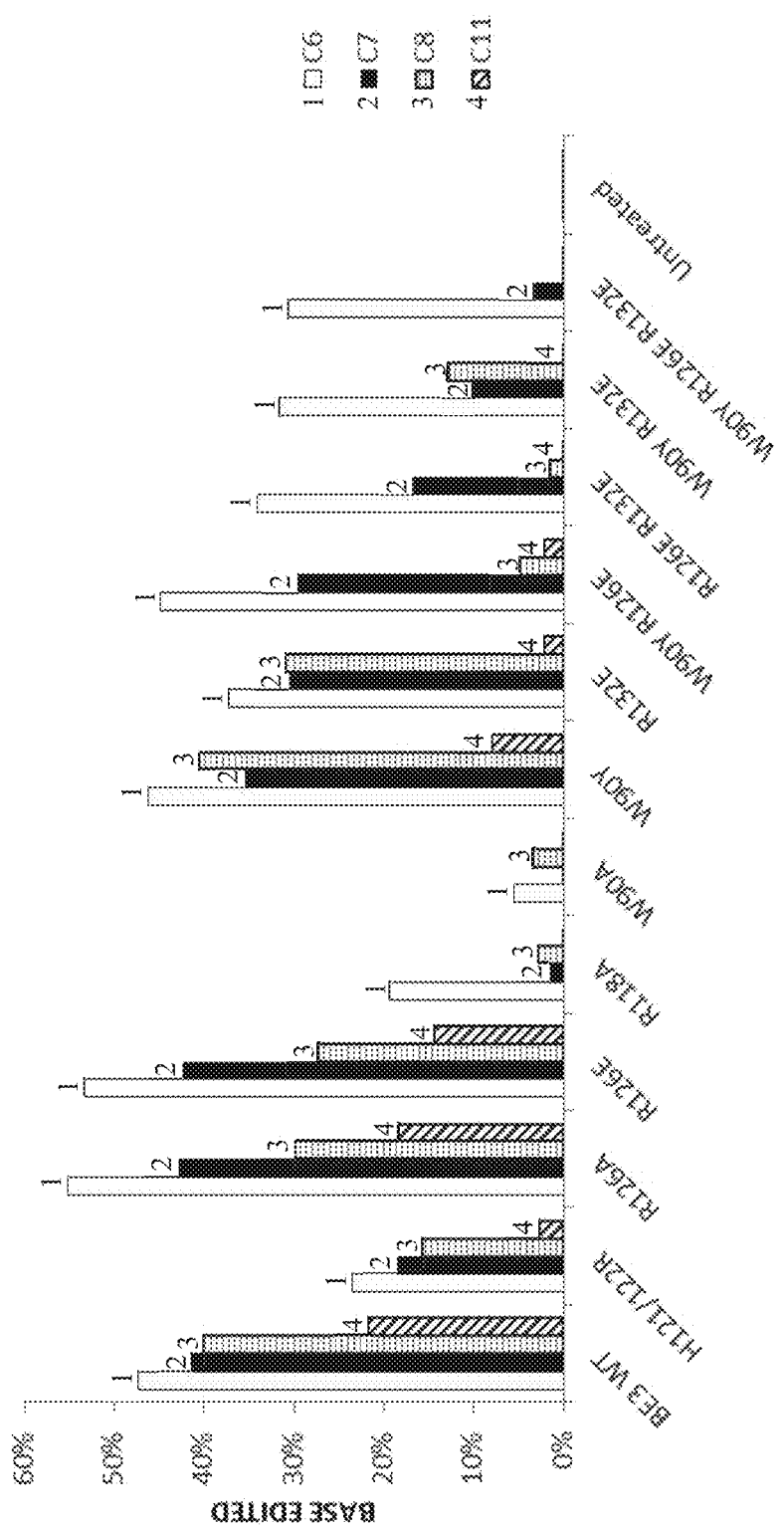

FIG. 57 is a graph demonstrating that mutations affect cytidine deamination with varying degrees. Combinations of mutations that each slightly impairs catalysis allow selective deamination at one position over others. The FANCF site was GGAATC$_6$C$_7$C$_8$TTC$_{11}$TGCAGCACCTGG (SEQ ID NO: 128).

Figure 58:
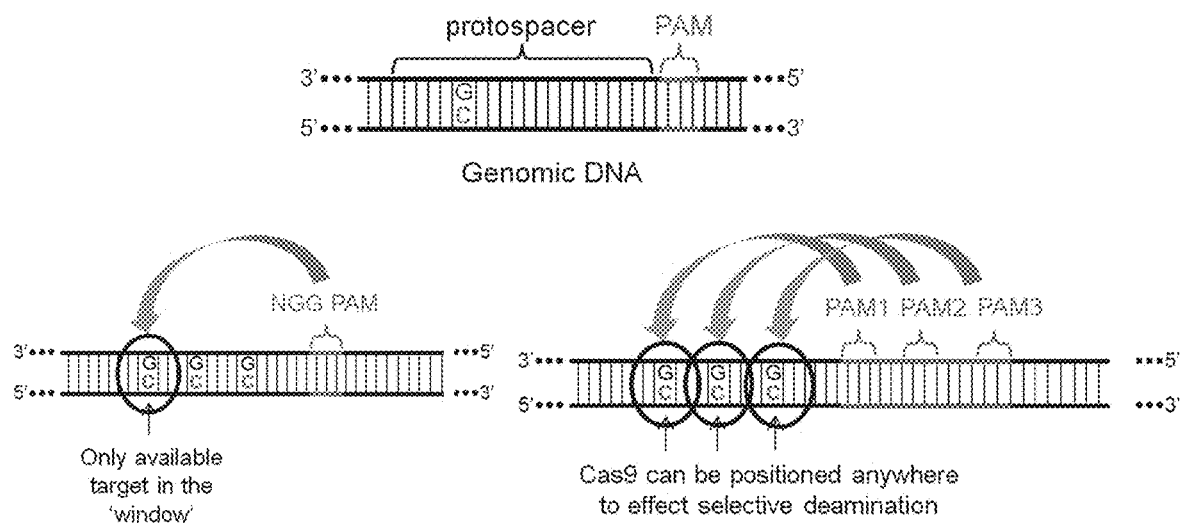

FIG. 58 is a schematic depicting next generation base editors.

Figure 59:
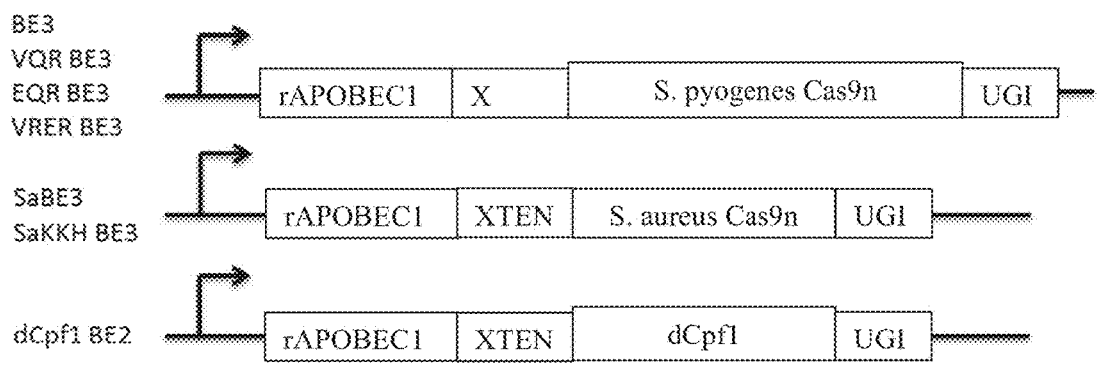

FIG. 59 is a schematic illustrating new base editors made from Cas9 variants.

Figure 60:
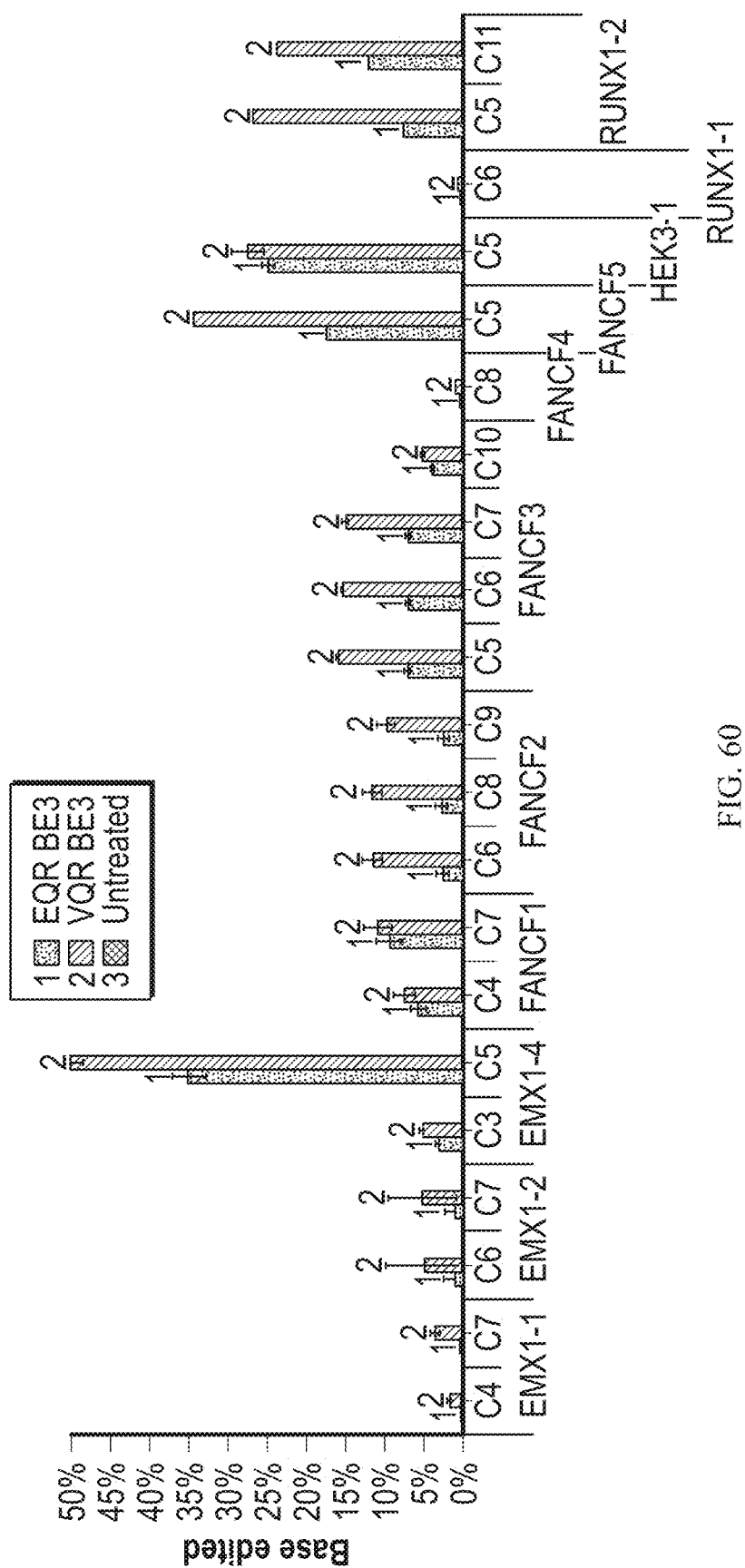

FIG. 60 shows the base-edited percentage of different NGA PAM sites.

Figure 61:
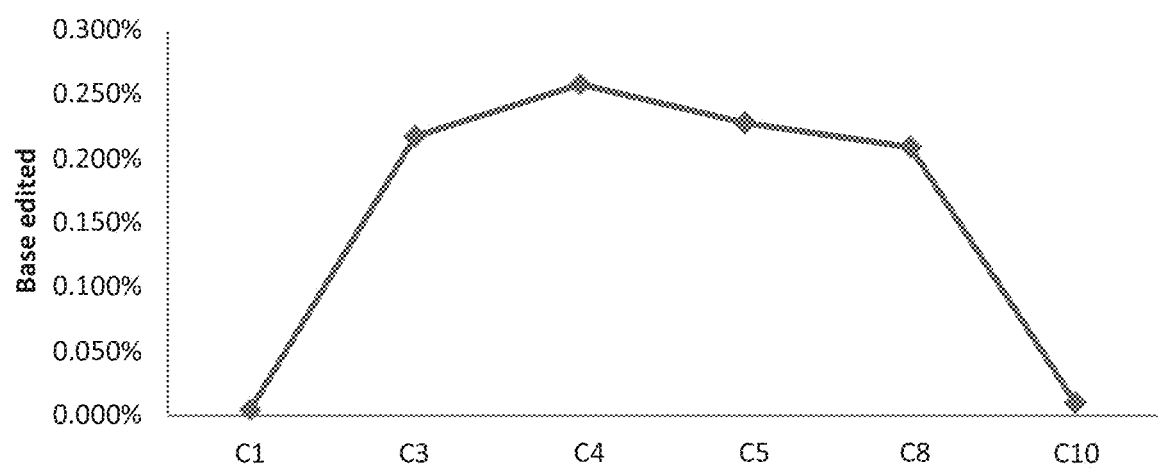

FIG. 61 shows the base-edited percentage of cytidines using NGCG PAM EMX (VRER BE3) and the C$_1$TC$_3$C$_4$C$_5$ATC$_8$AC$_{10}$ATCAACCGGT (SEQ ID NO: 696) spacer.

Figure 62:
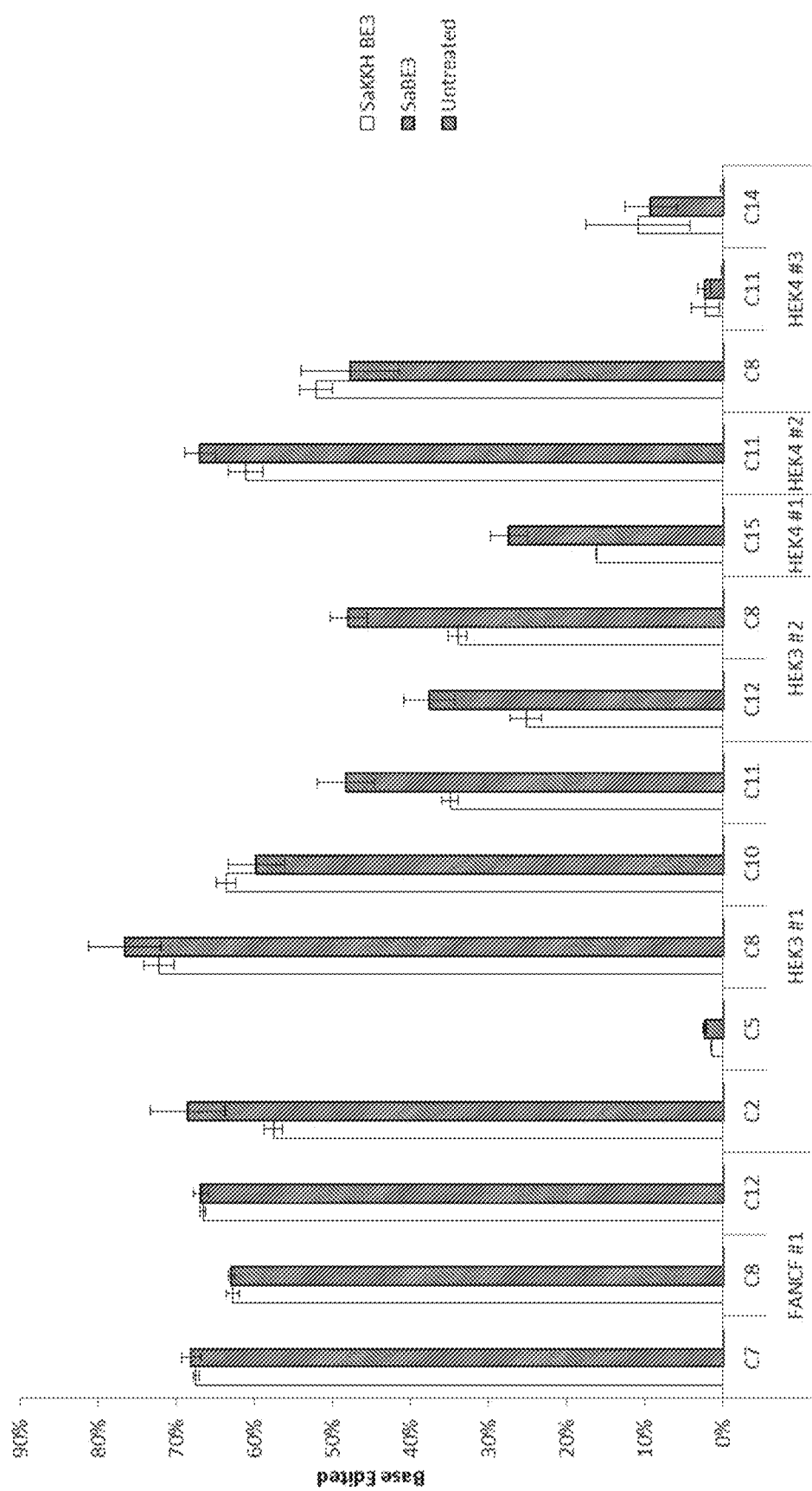

FIG. 62 shows the based-edited percentages resulting from different NNGRRT PAM sites.

Figure 63:
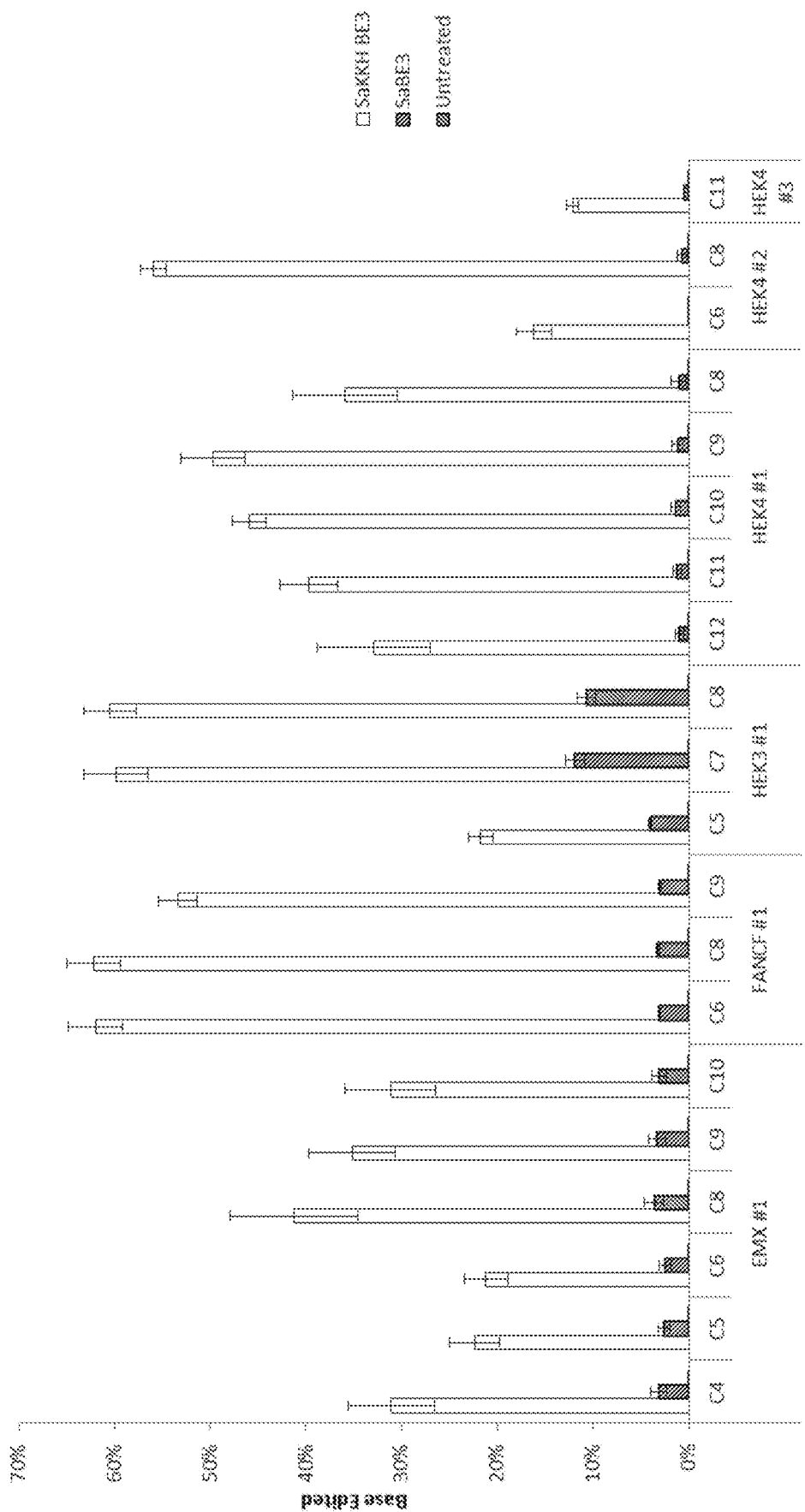

FIG. 63 shows the based-edited percentages resulting from different NNHRRT PAM sites.

Figure 64A:
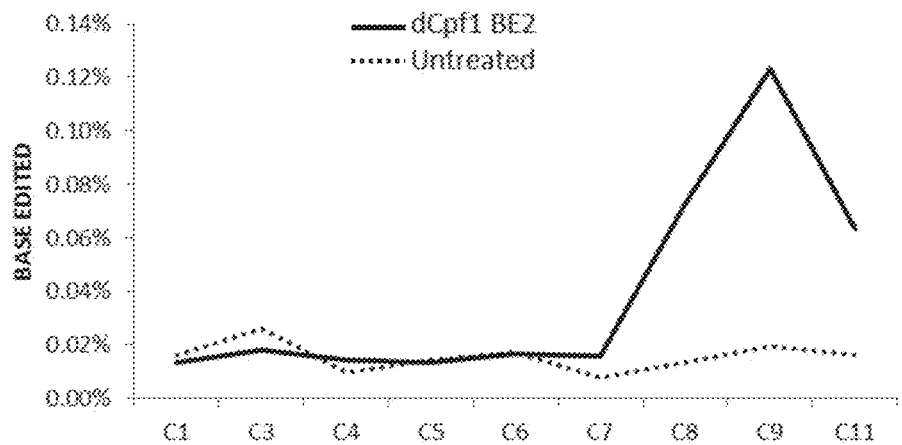
Figure 64B:
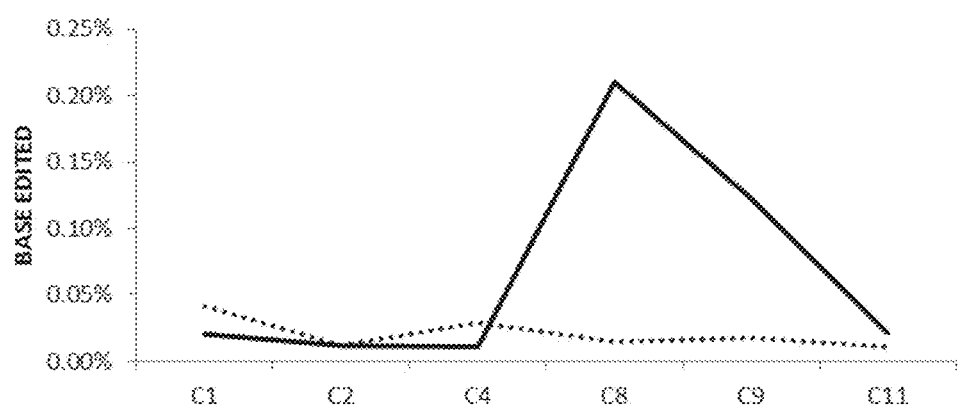
Figure 64C:
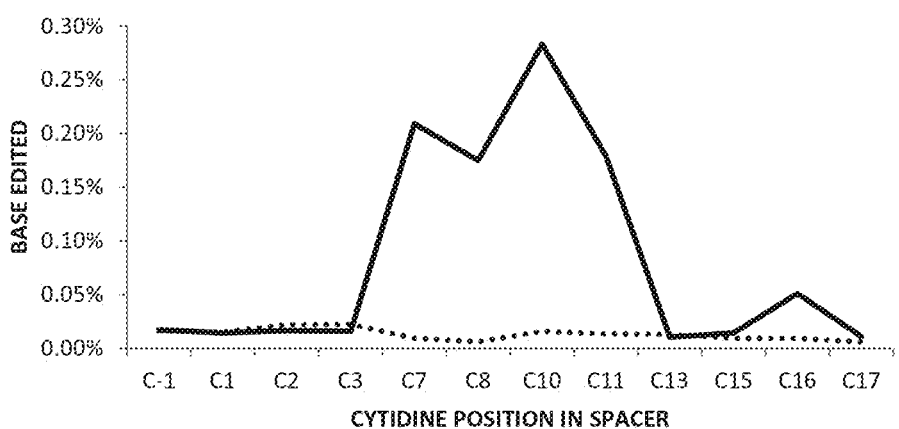

FIGS. 64A to 64C show the base-edited percentages resulting from different TTTN PAM sites using Cpf1 BE2. The spacers used were: TTTCCTC$_3$C$_4$C$_5$C$_6$C$_7$C$_8$C$_9$AC$_{11}$AGGTAGAACAT (FIG. 64A, SEQ ID NO: 697), TTTCC$_1$C$_2$TC$_4$TGTC$_8$C$_9$AC$_{11}$ACCCTCATCCTG (FIG. 64B, SEQ ID NO: 698), and TTTCC$_1$C$_2$C$_3$AGTC$_7$C$_8$TC$_{10}$C$_{11}$AC$_{13}$AC$_{15}$C$_{16}$C$_{17}$TGAAAC (FIG. 64C, SEQ ID NO: 699).

Figure 65:
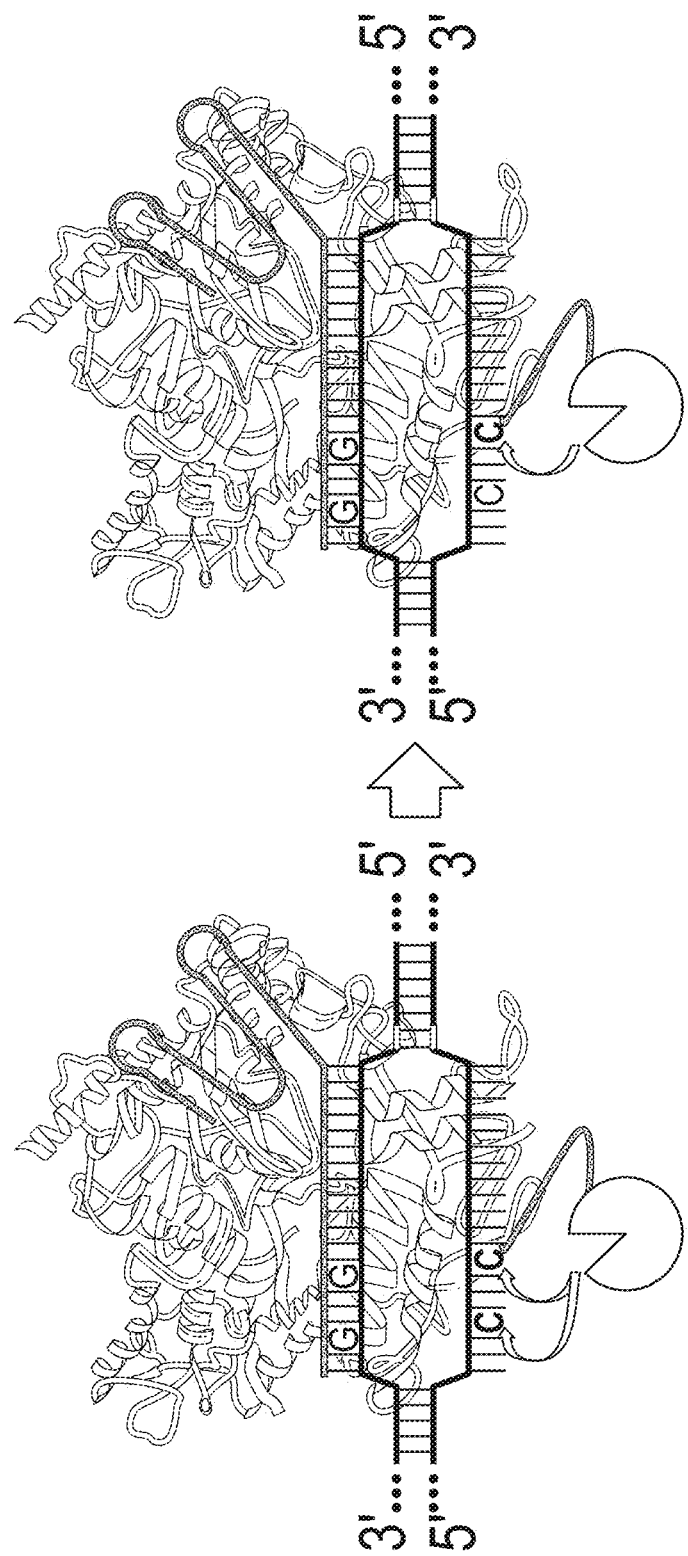

FIG. 65 is a schematic depicting selective deamination as achieved through kinetic modulation of cytidine deaminase point mutagenesis.

Figure 66:
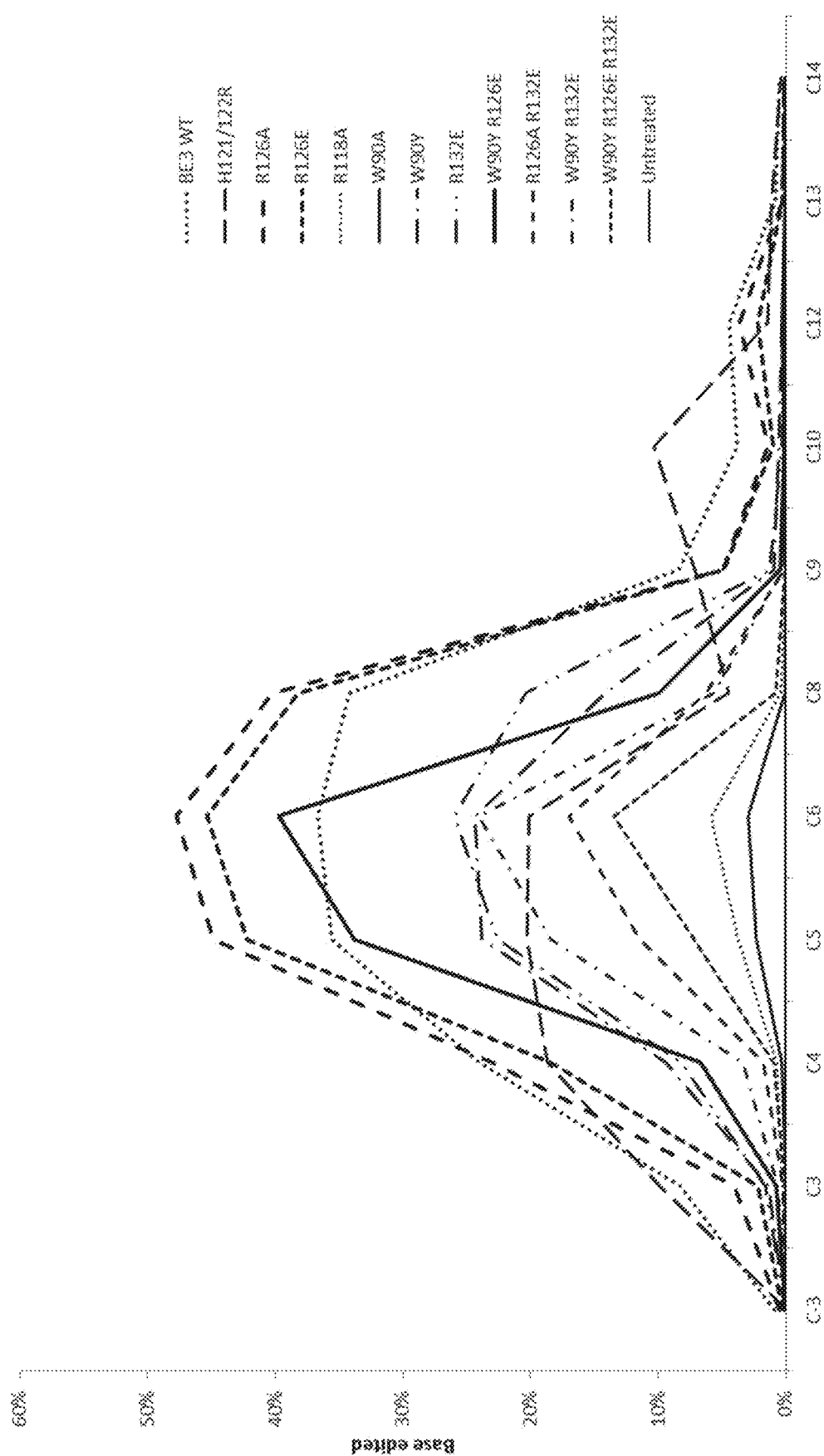

FIG. 66 is a graph showing the effect of various mutations on the deamination window probed in cell culture with multiple cytidines in the spacer. The spacer used was: TGC$_3$C$_4$C$_5$C$_6$TC$_8$C$_9$C$_{10}$TC$_{12}$C$_{13}$C$_{14}$TGGCCC (SEQ ID NO: 700).

Figure 67:
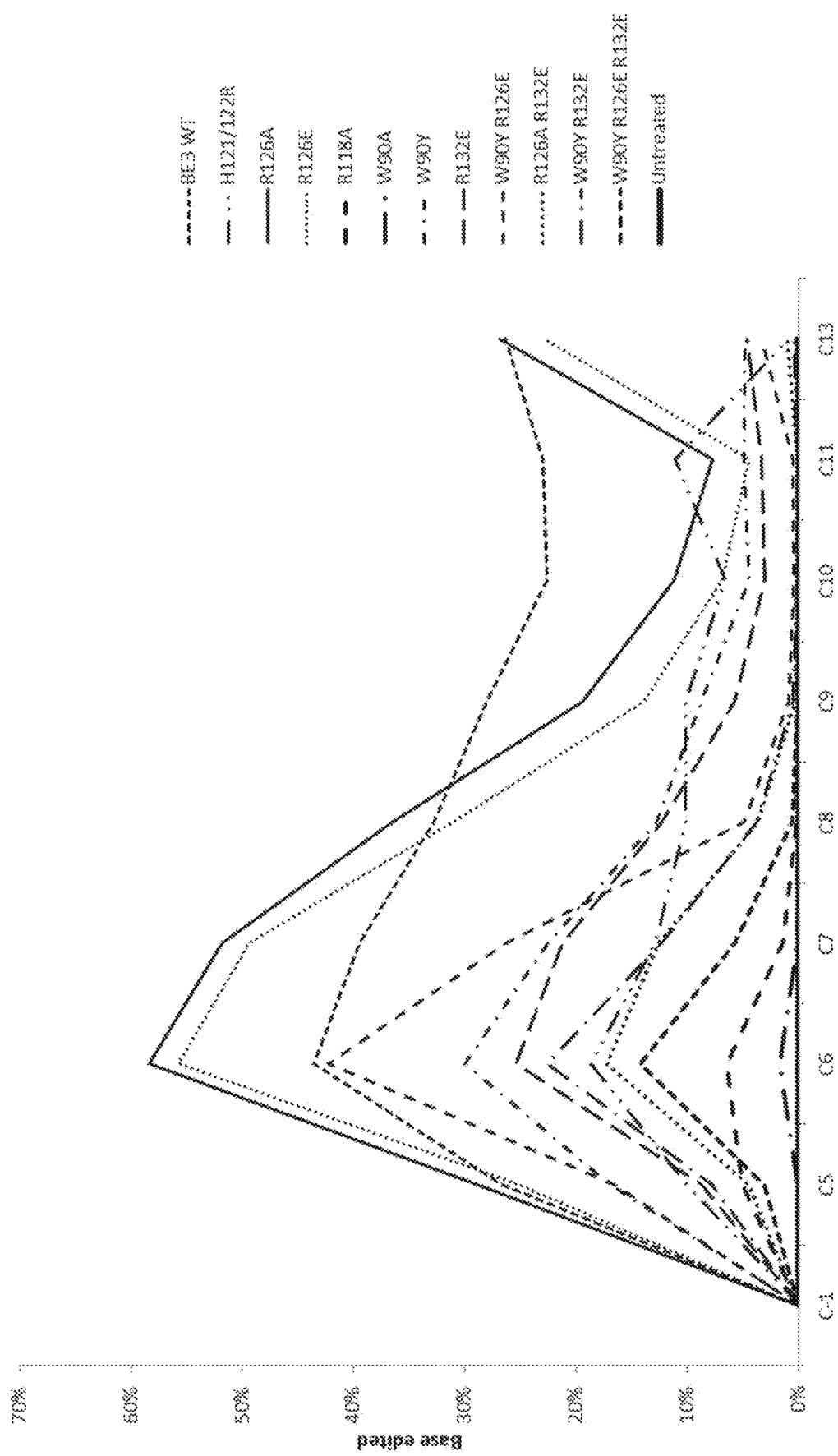

FIG. 67 is a graph showing the effect of various mutations on the deamination window probed in cell culture with multiple cytidines in the spacer. The spacer used was: AGAGC$_5$C$_6$C$_7$C$_8$C$_9$C$_{10}$C$_{11}$TC$_{13}$AAAGAGA (SEQ ID NO: 701).

Figure 68:
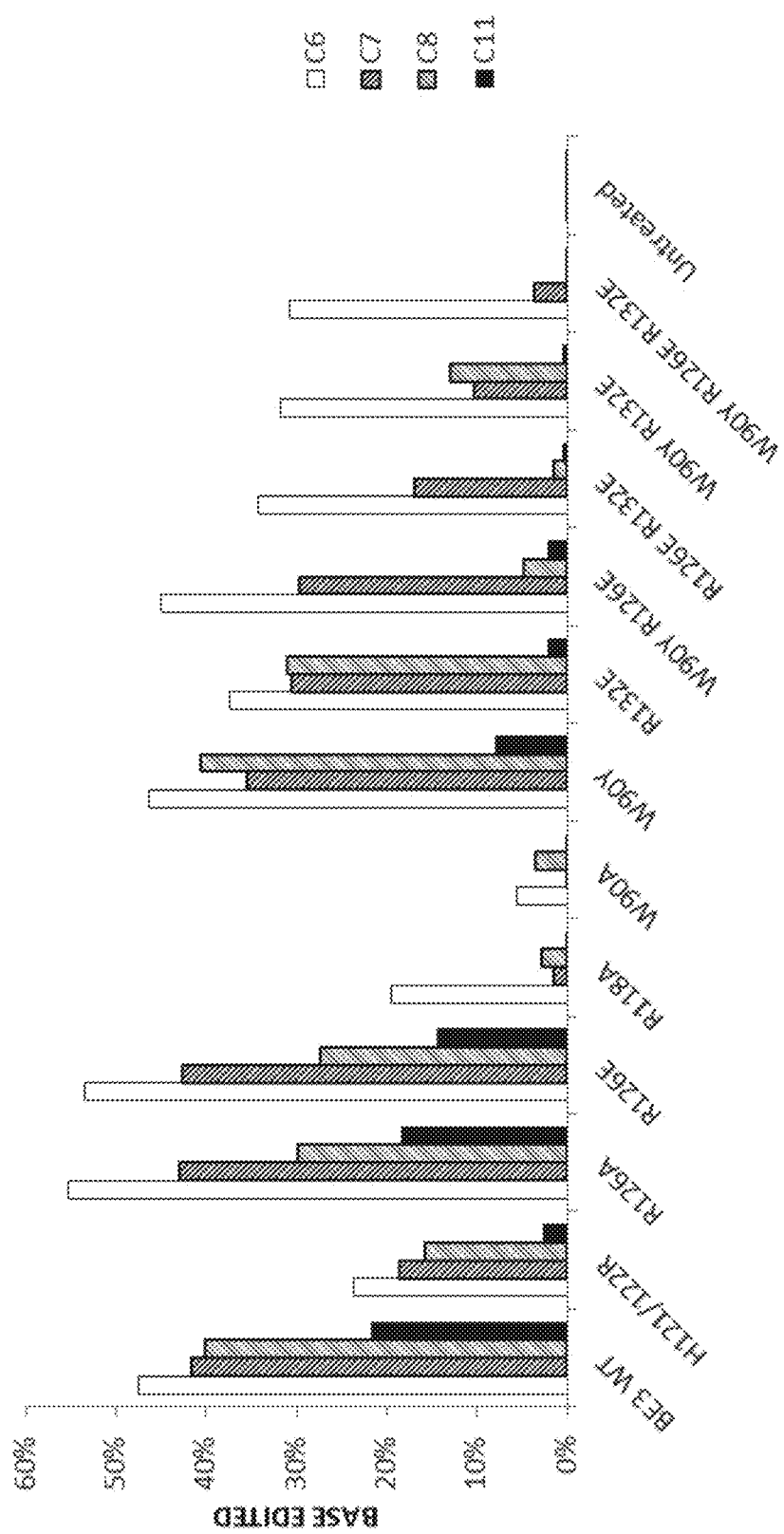

FIG. 68 is a graph showing the effect of various mutations on the FANCF site with a limited number of cytidines. The spacer used was: GGAATC$_6$C$_7$C$_8$TTC$_{11}$TGCAGCACCTGG (SEQ ID NO: 128). Note that the triple mutant (W90Y, R126E, R132E) preferentially edits the cytidine at the sixth position.

Figure 69:
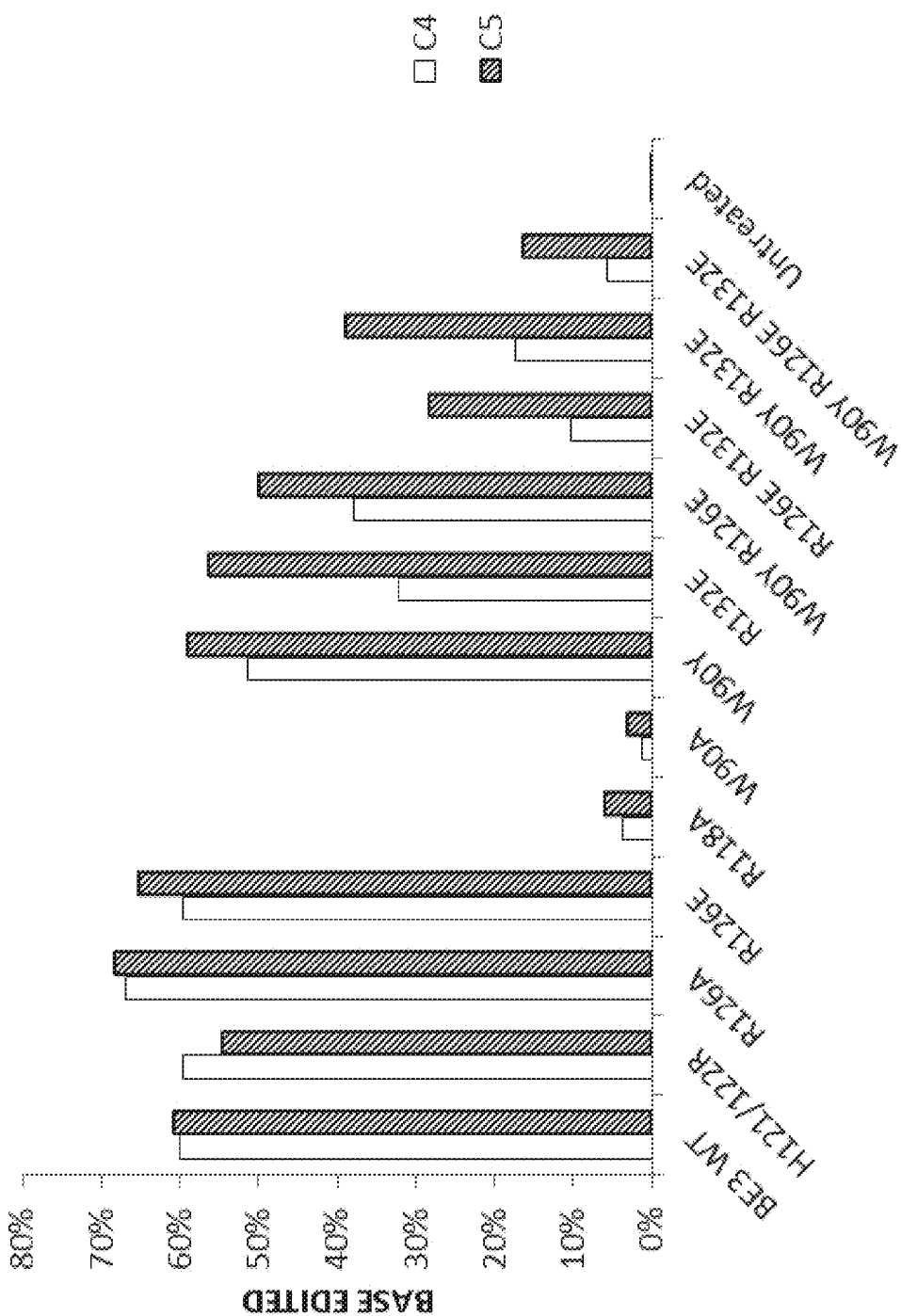

FIG. 69 is a graph showing the effect of various mutations on the HEK3 site with a limited number of cytidines. The spacer used was: GGCC$_4$C$_5$AGACTGAGCACGTGATGG (SEQ ID NO: 702). Note that the double and triple mutants preferentially edit the cytidine at the fifth position over the cytidine in the fourth position.

Figure 70:
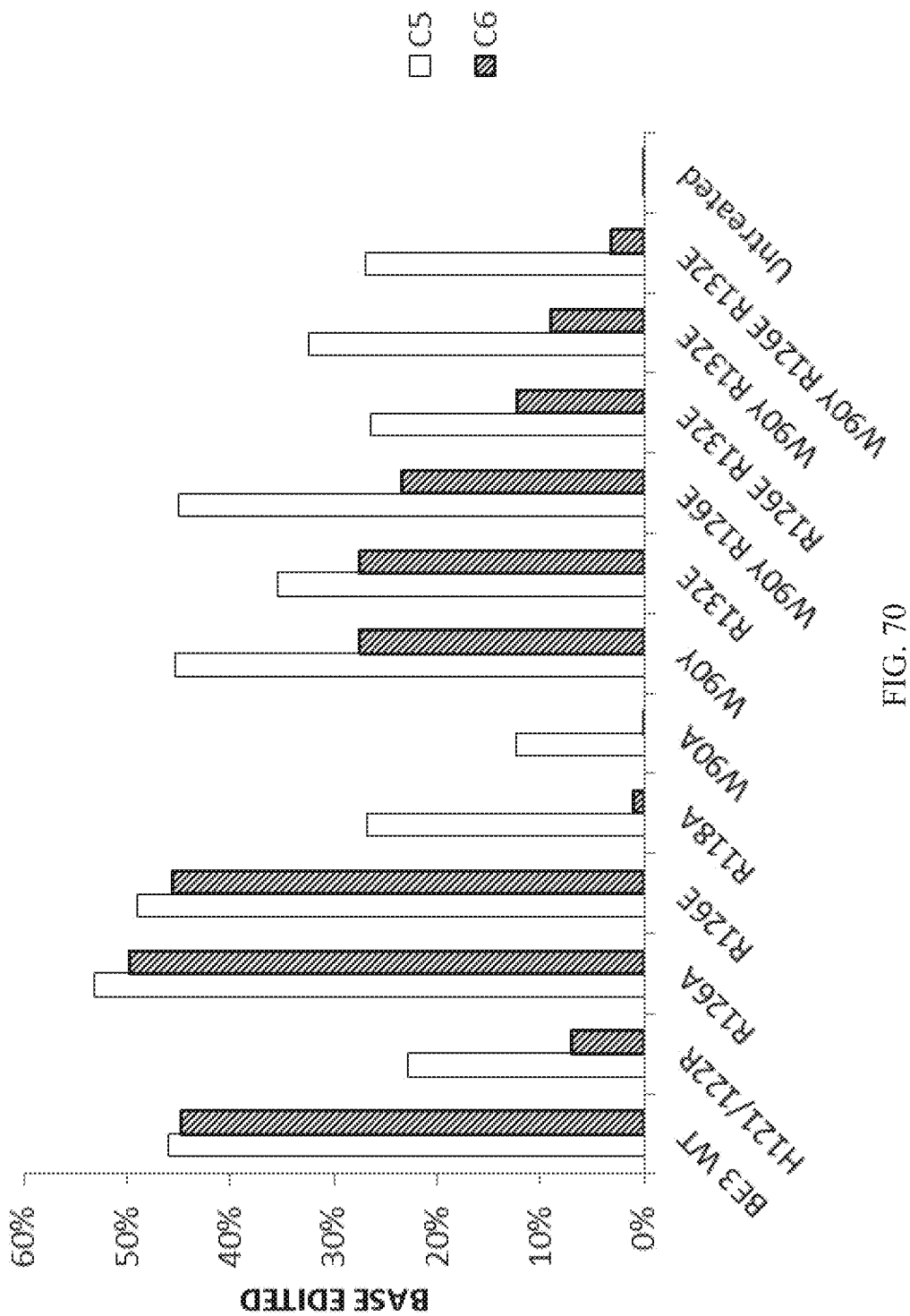

FIG. 70 is a graph showing the effect of various mutations on the EMX1 site with a limited number of cytidines. The spacer used was: GAGTC$_5$C$_6$GAGCAGAAGAAGAAGGG (SEQ ID NO: 703). Note that the triple mutant only edits the cytidine at the fifth position, not the sixth.

Figure 71:
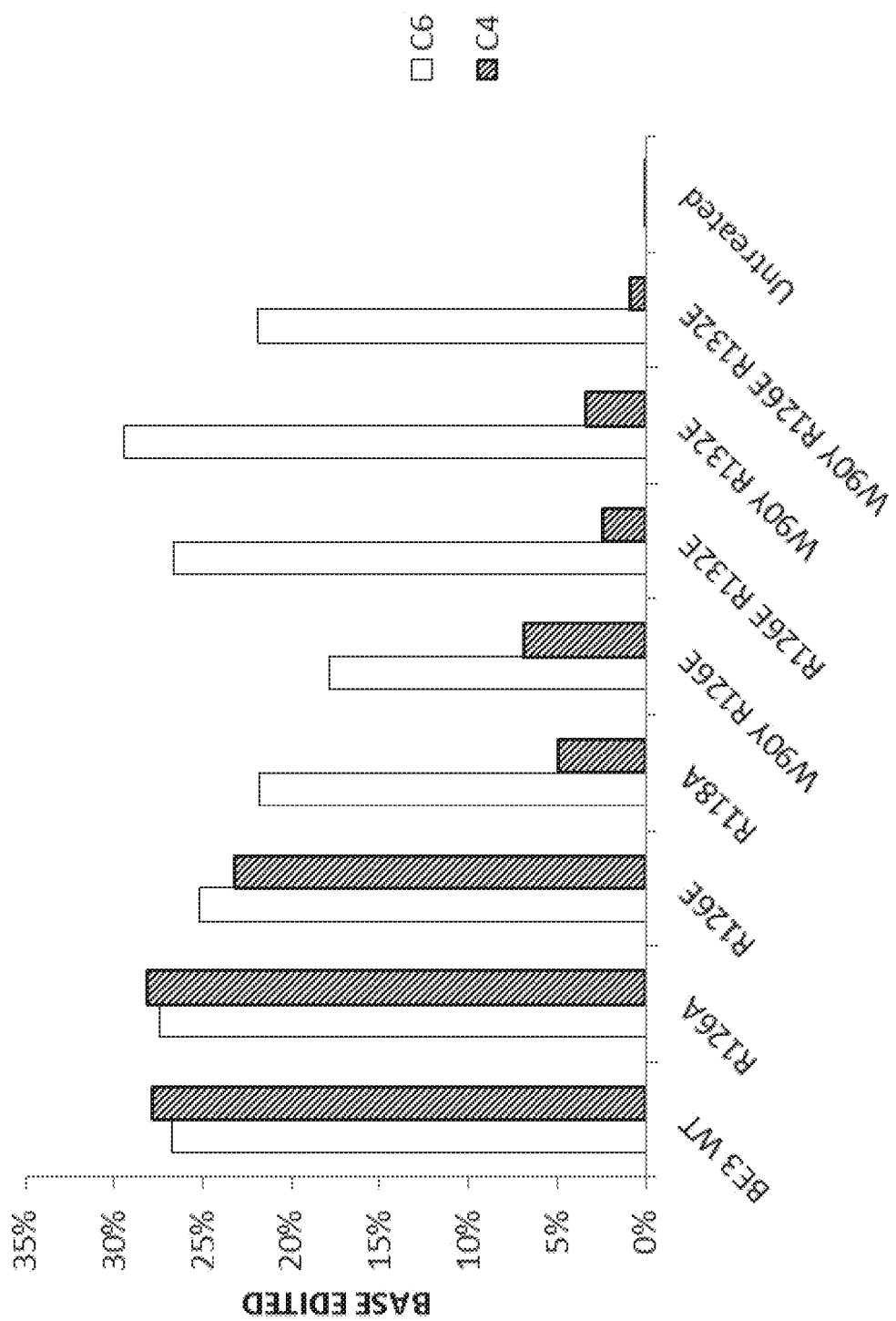

FIG. 71 is a graph showing the effect of various mutations on the HEK2 site with a limited number of cytidines. The spacer used was: GAAC$_4$AC$_6$AAAGCATAGACTGCGGG (SEQ ID NO: 704).

FIG. 72 shows on-target base editing efficiencies of BE3 and BE3 comprising mutations W90Y R132E in immortalized astrocytes.

Figure 73:
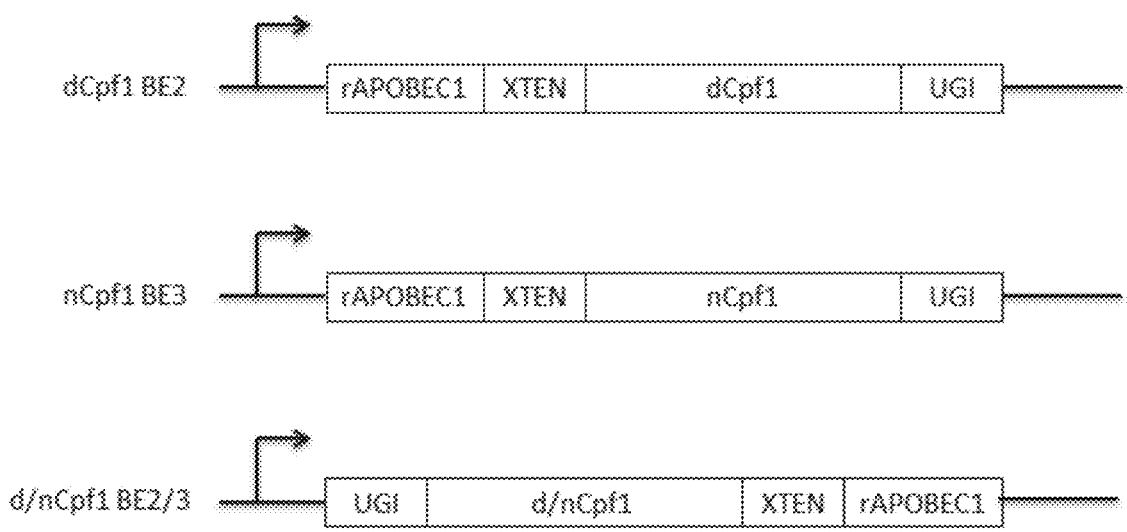

FIG. 73 depicts a schematic of three Cpf1 fusion constructs.

Figure 74:
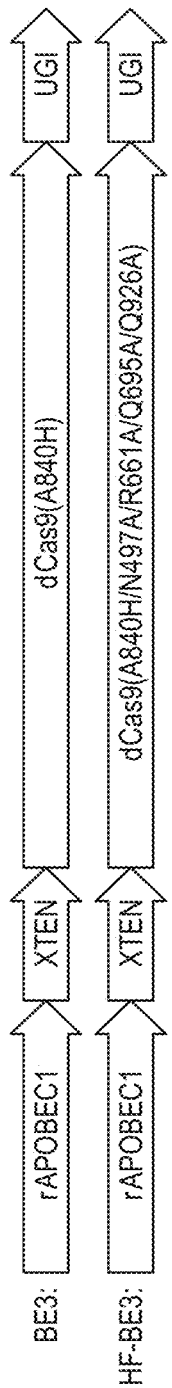

FIG. 74 shows a comparison of plasmid delivery of BE3 and HF-BE3 (EMX1, FANCF, and RNF2).

Figure 75:
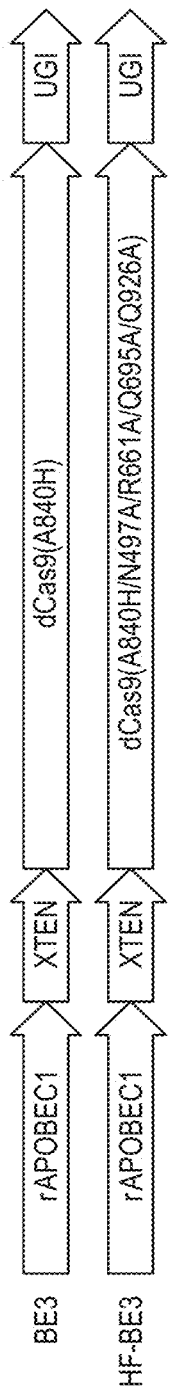

FIG. 75 shows a comparison of plasmid delivery of BE3 and HF-BE3 (HEK3 and HEK 4).

Figure 76A:
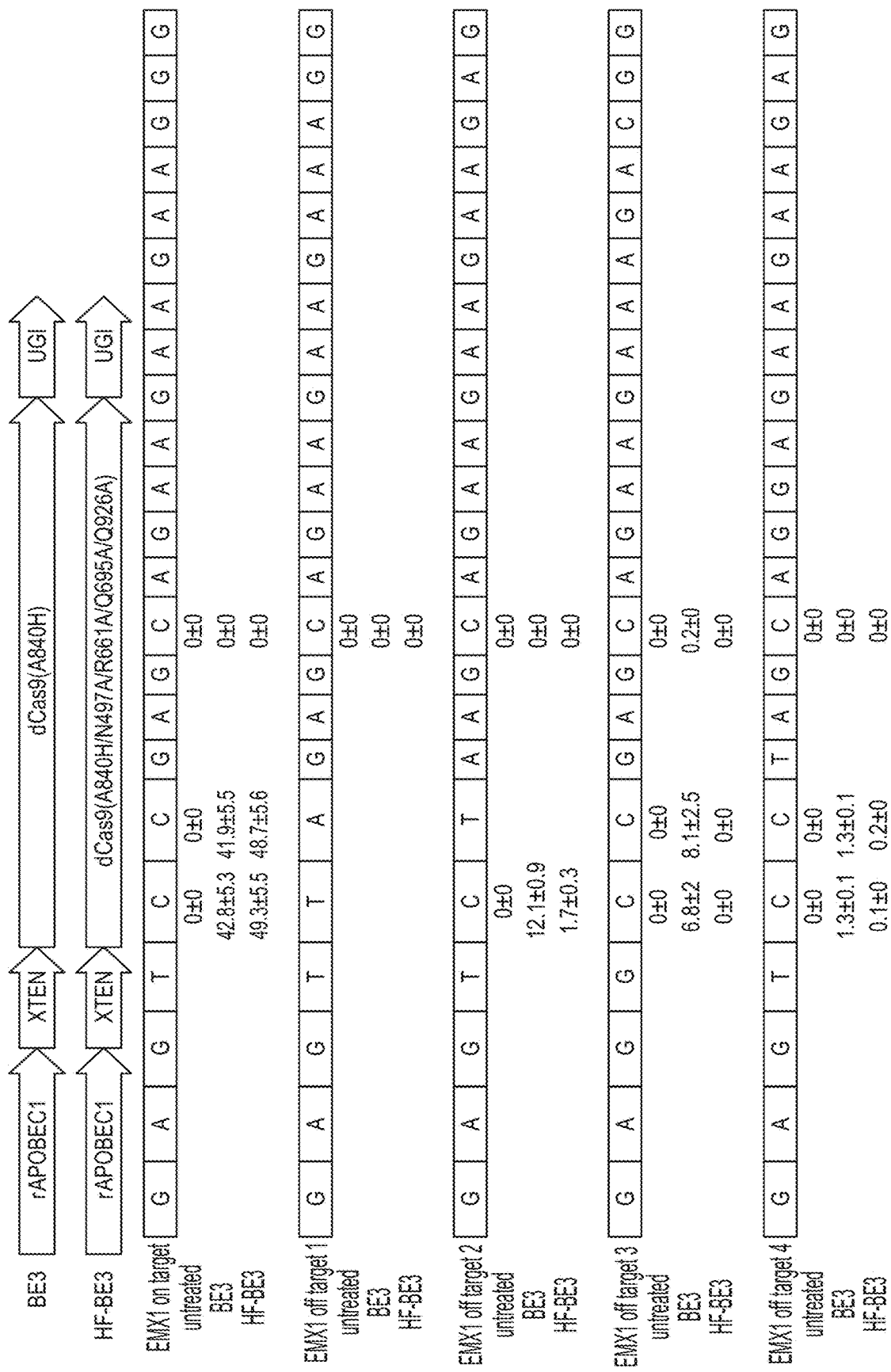

FIGS. 76A to 76B shows off-target editing of EMX-1 at all 10 sites. This figure depicts SEQ ID NOs: 127 and 637-645

FIG. 77 shows deaminase protein lipofection to HEK cells using a GAGTCCGAGCAGAAGAAGAAG (SEQ ID NO: 705) spacer. The EMX-1 on-target and EMX-1 off target site 2 were examined.

Figure 78:
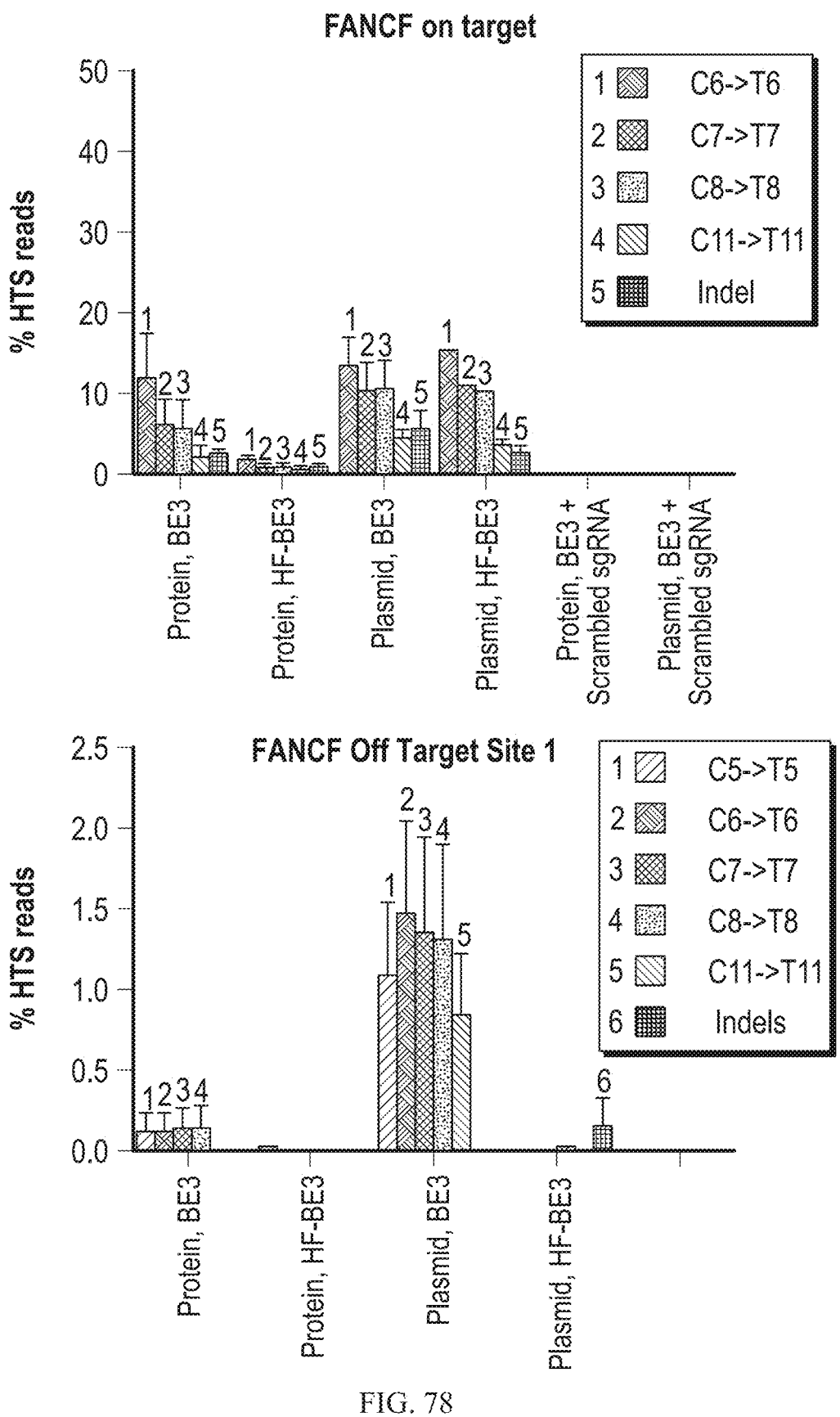

FIG. 78 shows deaminase protein lipofection to HEK cells using a GGAATCCCTTCTGCAGCACCTGG (SEQ ID NO: 706) spacer. The FANCF on target and FANCF off target site 1 were examined.

Figure 79:
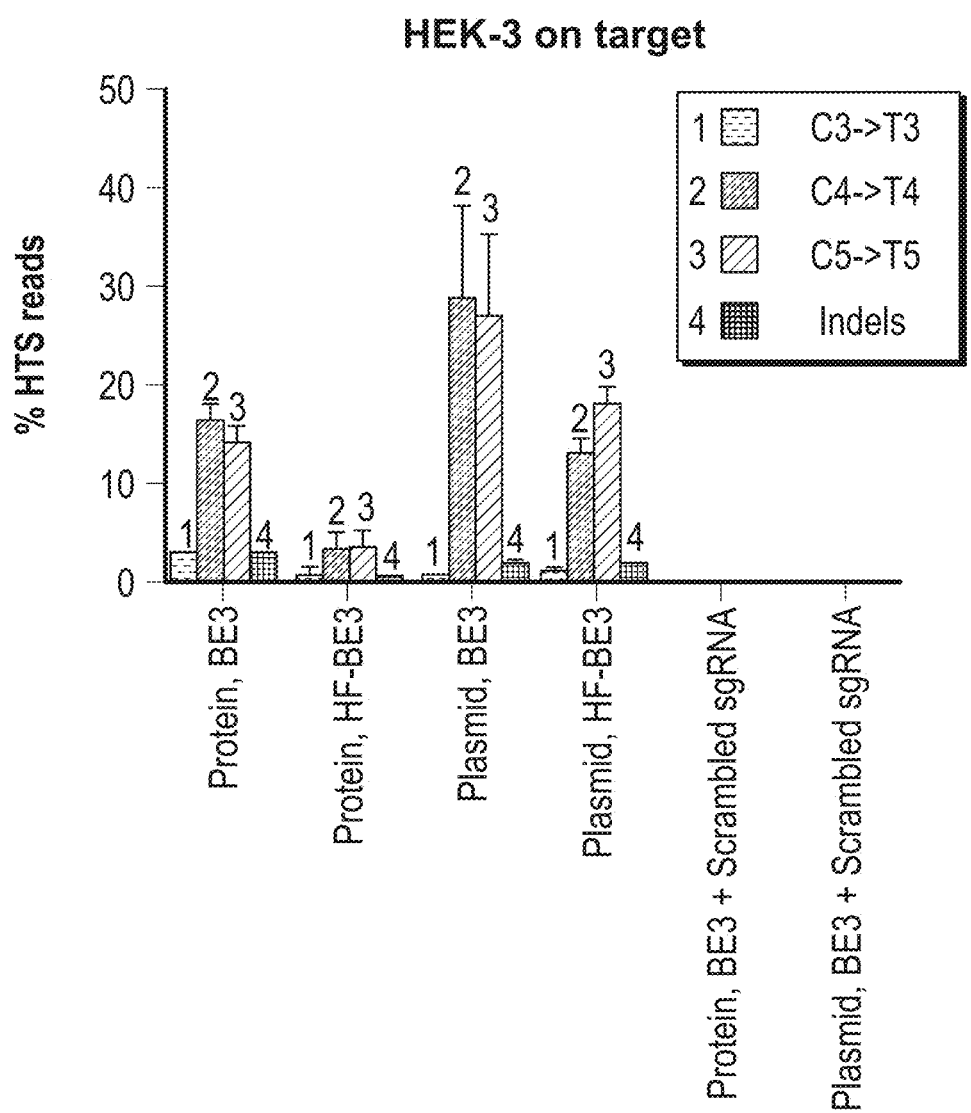

FIG. 79 shows deaminase protein lipofection to HEK cells using a GGCCCAGACTGAGCACGTGA (SEQ ID NO: 707) spacer. The HEK-3 on target site was examined.

Figure 80A:
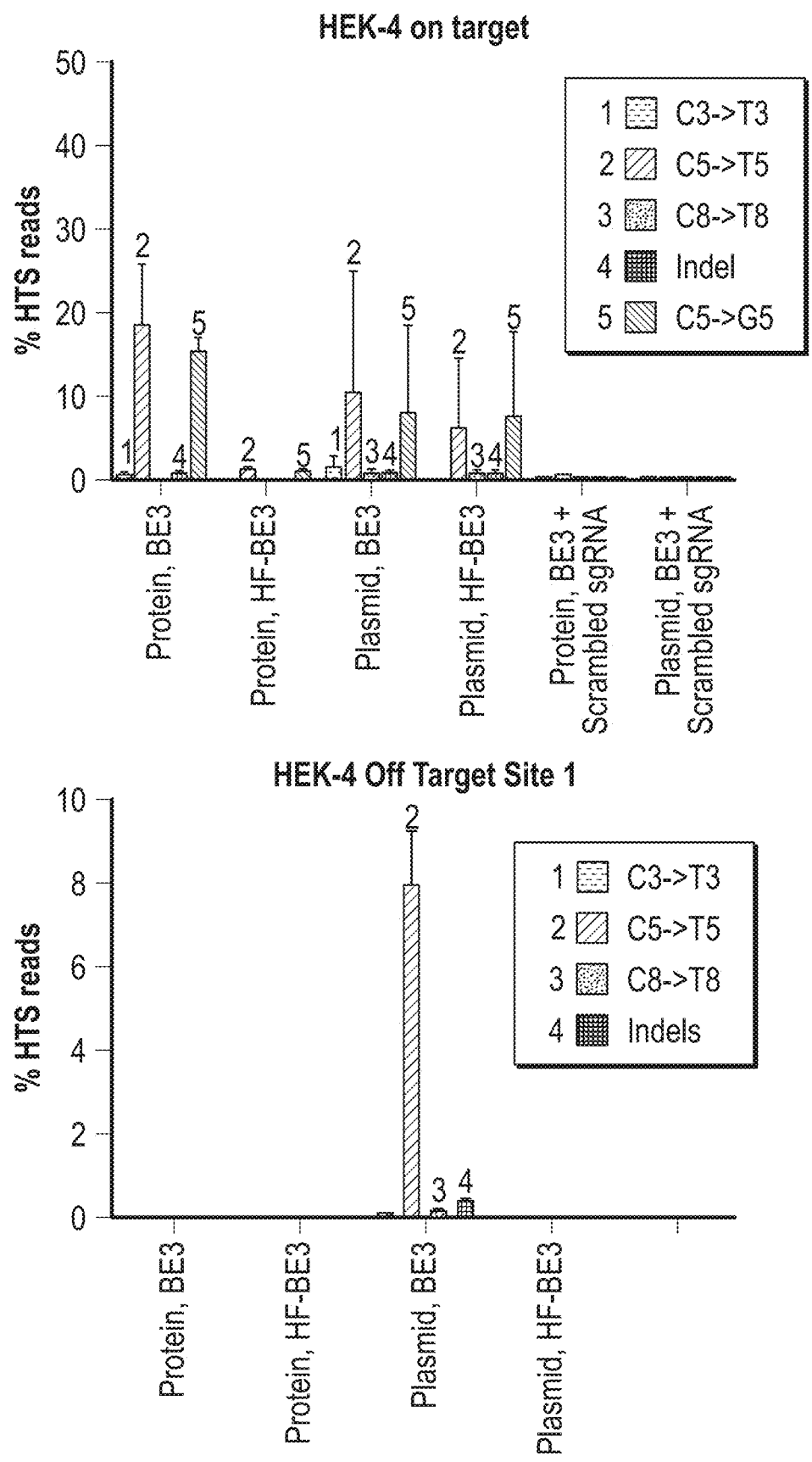

FIGS. 80A to 80B show deaminase protein lipofection to HEK cells using a GGCACTGCGGCTGGAGGTGGGGG (SEQ ID NO: 708) spacer. The HEK-4 on target, off target site 1, site 3, and site 4.

Figure 81:
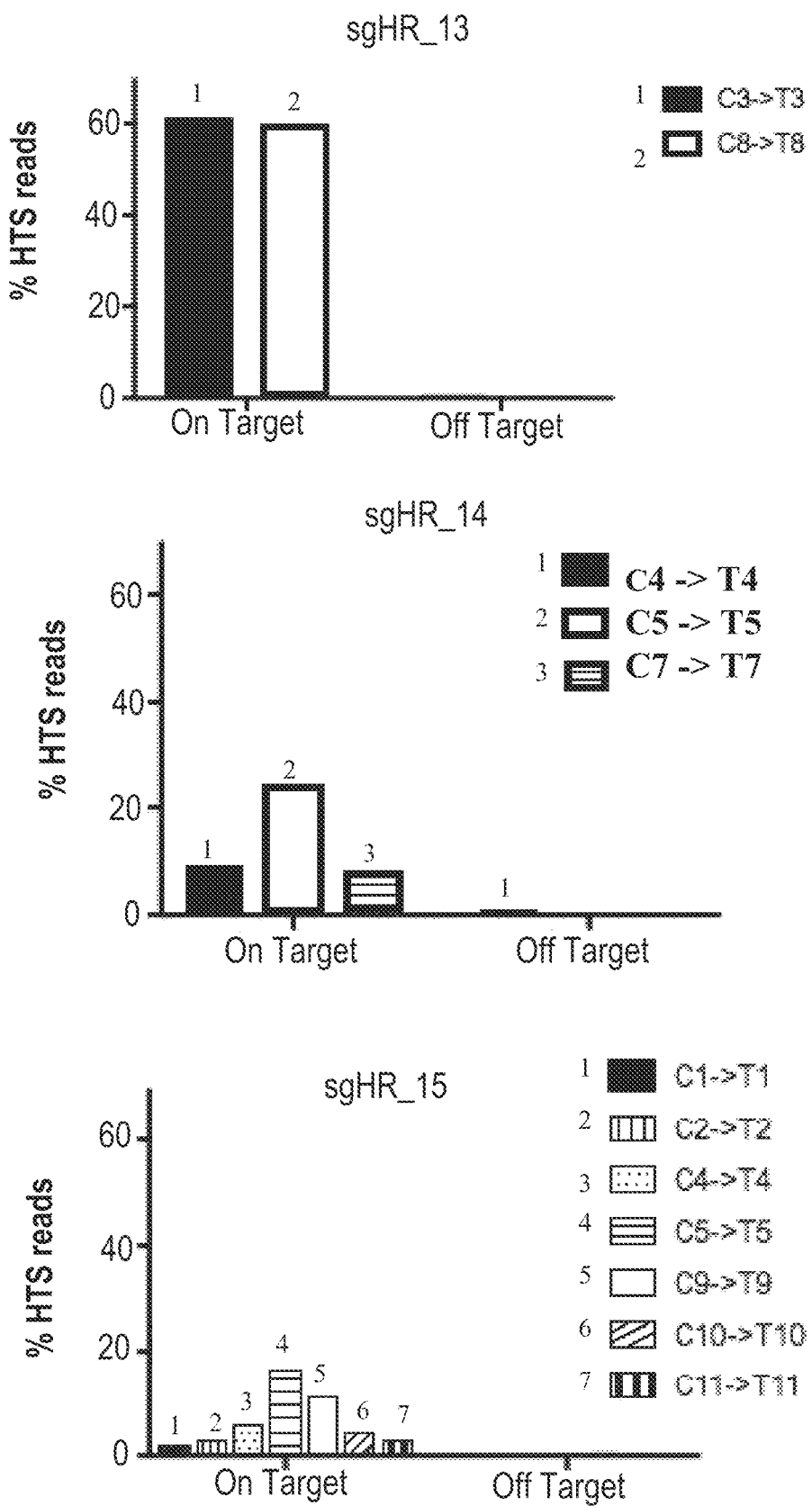

FIG. 81 shows the results of an in vitro assay for sgRNA activity for sgHR_13 (GTCAGGTCGAGGGTTCTGTC (SEQ ID NO: 709) spacer; C8 target: G51 to STOP), sgHR_14 (GGGCCGCAGTATCCTCACTC (SEQ ID NO: 710) spacer; C7 target; C7 target: Q68 to STOP), and sgHR_15 (CCGCCAGTCCCAGTACGGGA (SEQ ID NO: 711) spacer; C10 and C11 are targets: W239 or W237 to STOP).

Figure 82:
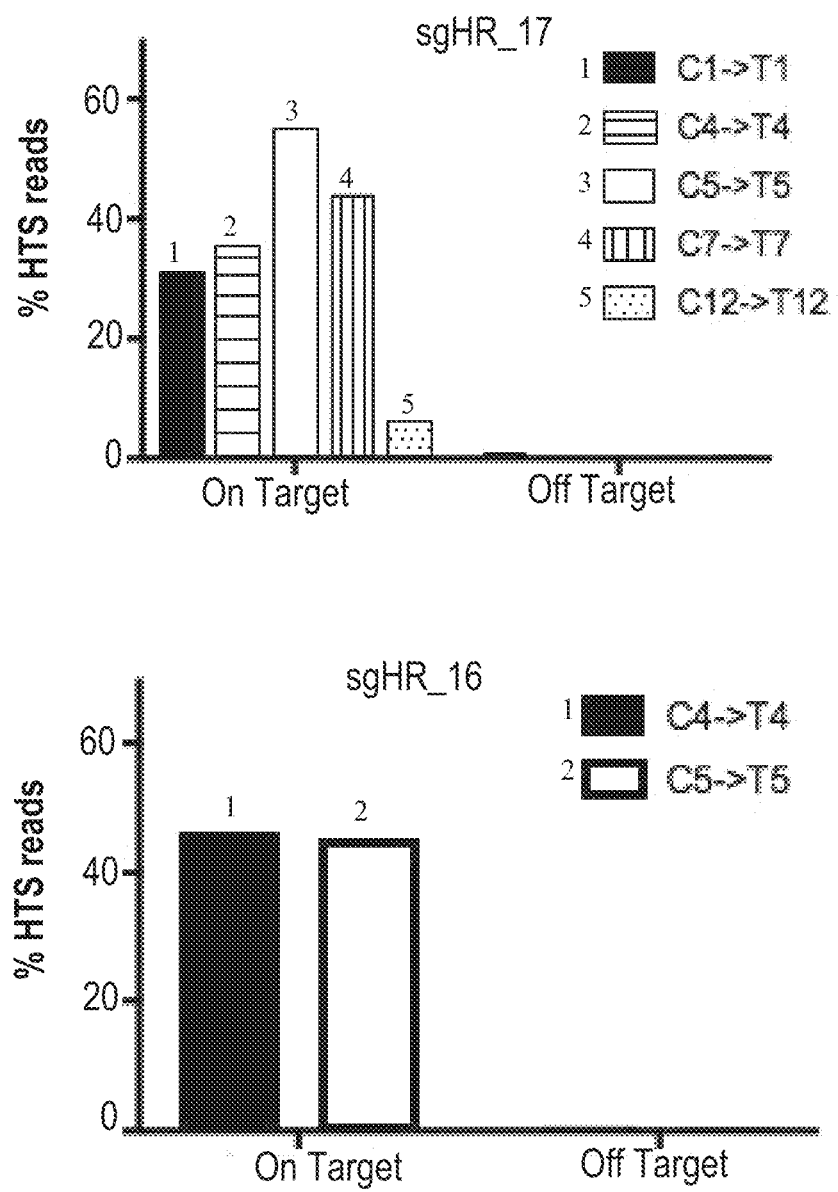

FIG. 82 shows the results of an in vitro assay for sgHR_17 (CAACCACTGCTCAAAGATGC (SEQ ID NO: 712) spacer; C4 and C5 are targets: W410 to STOP), and sgHR_16 (CTTCCAGGATGAGAACACAG (SEQ ID NO: 713) spacer; C4 and C5 are targets: W273 to STOP).

Figure 83:
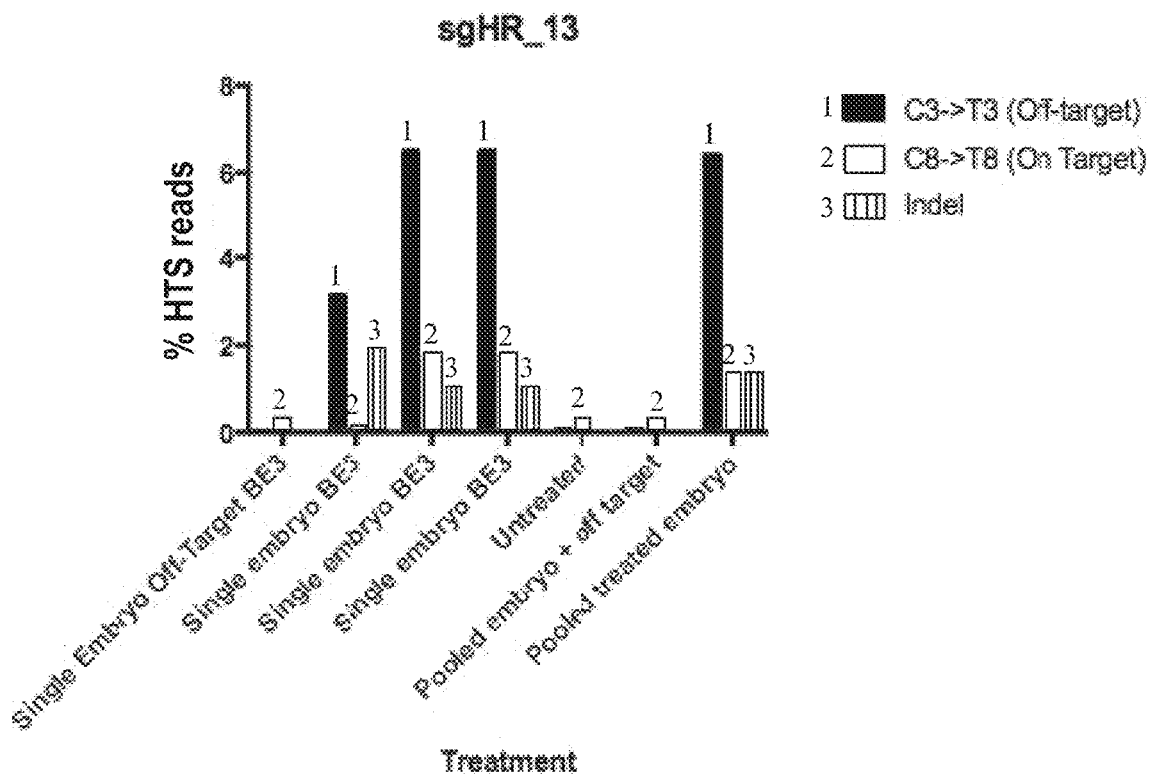

FIG. 83 shows the direct injection of BE3 protein complexed with sgHR_13 in zebrafish embryos.

Figure 84:
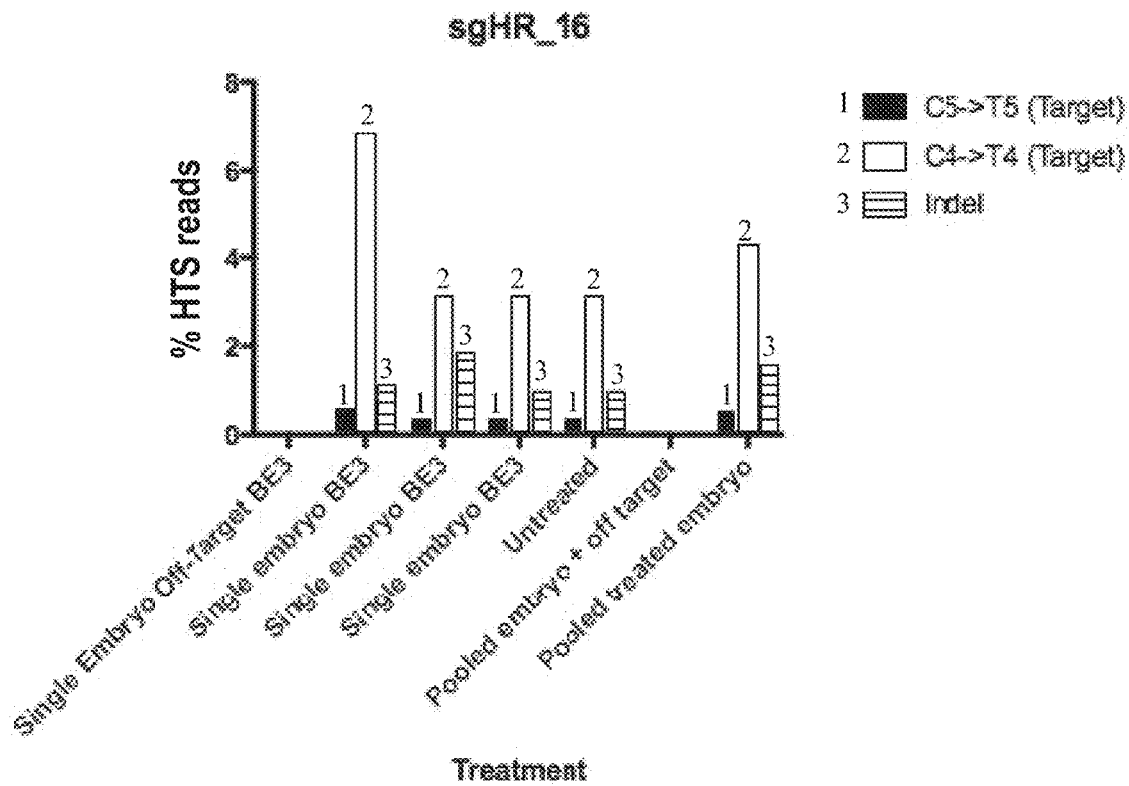

FIG. 84 shows the direct injection of BE3 protein complexed with sgHR_16 in zebrafish embryos.

Figure 85:
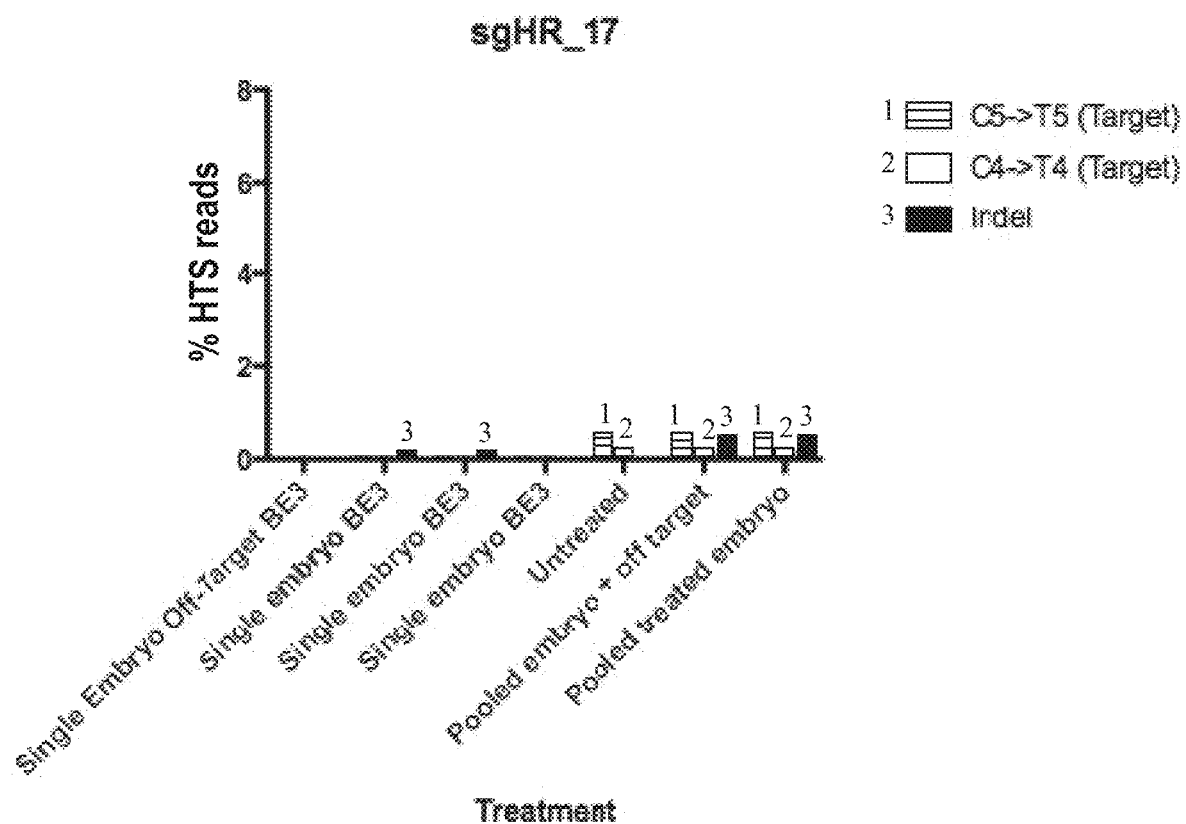

FIG. 85 shows the direct injection of BE3 protein complexed with sgHR_17 in zebrafish embryos.

Figure 86:
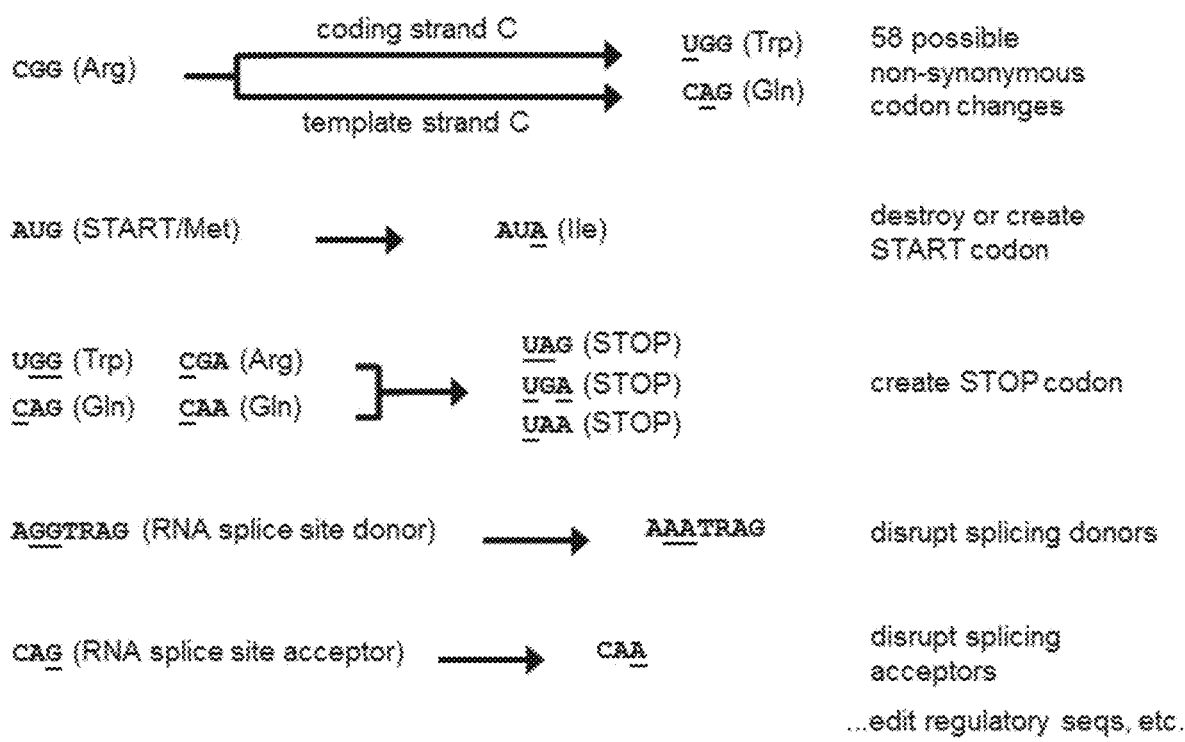

FIG. 86 shows exemplary nucleic acid changes that may be made using base editors that are capable of making a cytosine to thymine change.

Figure 87:
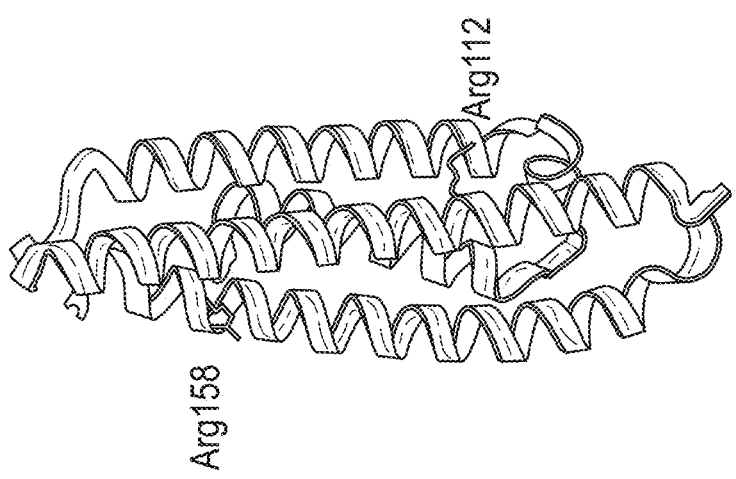
Figure 90A:
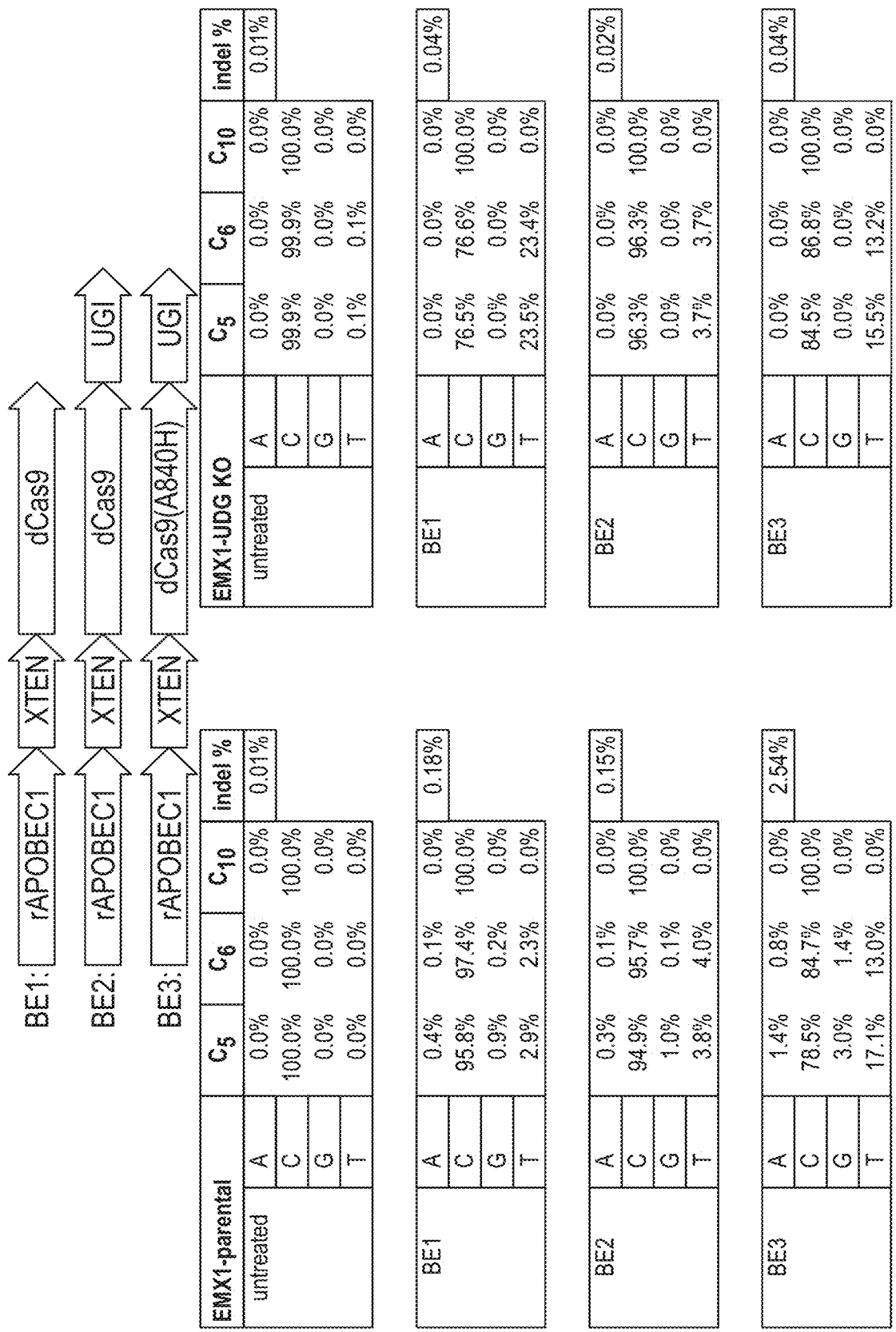

FIG. 87 shows an illustration of apolipoprotein E (APOE) isoforms, demonstrating how a base editor (e.g., BE3) may be used to edit one APOE isoform (e.g., APOE4) into another APOE isoform (e.g., APOE3r) that is associated with a decreased risk of Alzheimer's disease.

Figure 88:
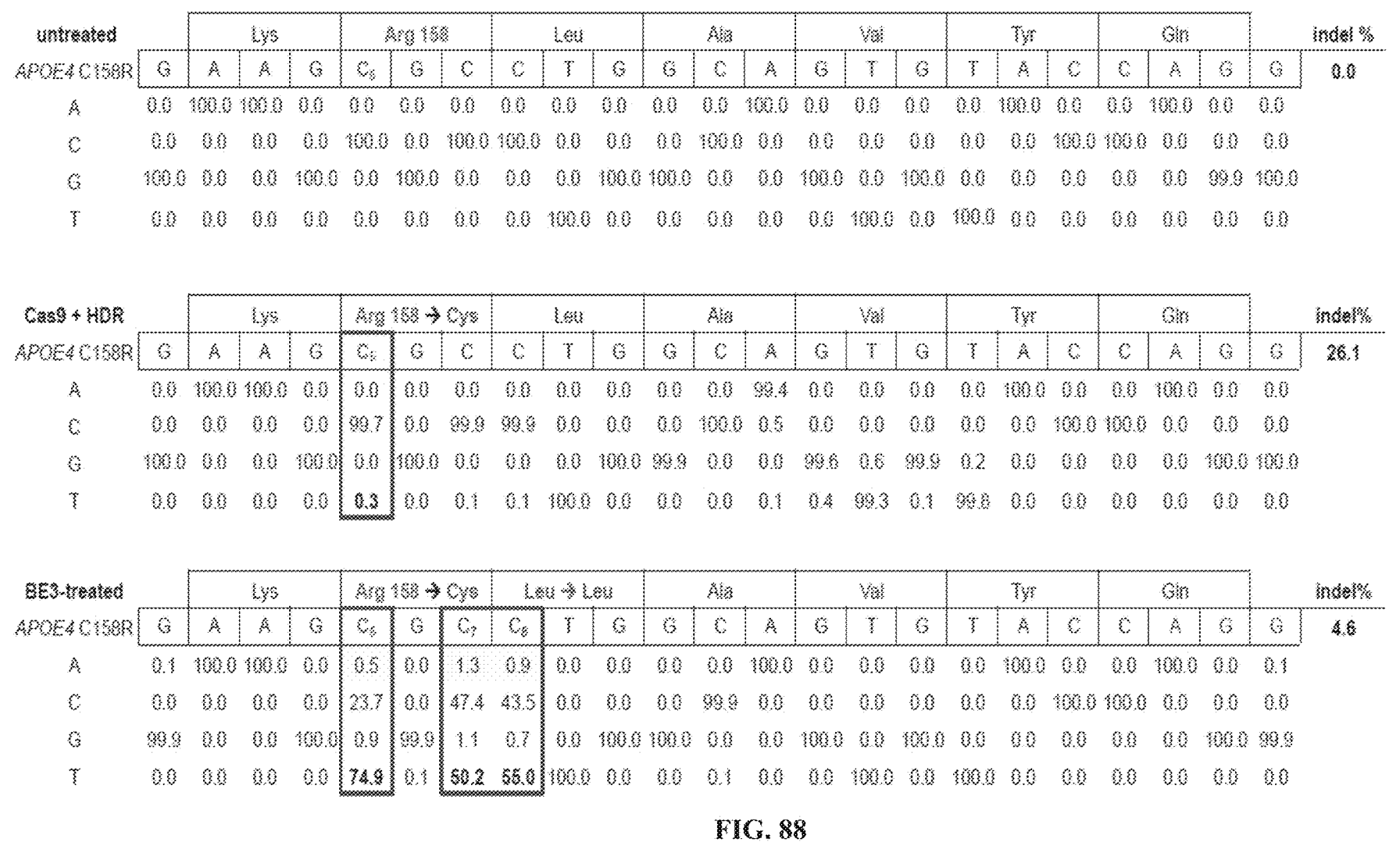

FIG. 88 shows base editing of APOE4 to APOE3r in mouse astrocytes. This figure depicts SEQ ID Nos: 671 and 627.

FIG. 89 shows base editing of PRNP to cause early truncation of the protein at arginine residue 37. This figure depicts SEQ ID Nos: 577 and 714.

FIGS. 90A to 90D shows that knocking out UDG (which UGI inhibits) dramatically improves the cleanliness of efficiency of C to T base editing.

Figure 91A:
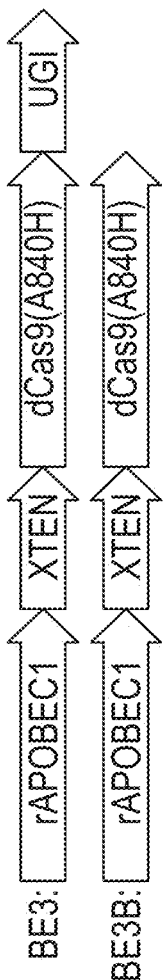
Figure 91B:
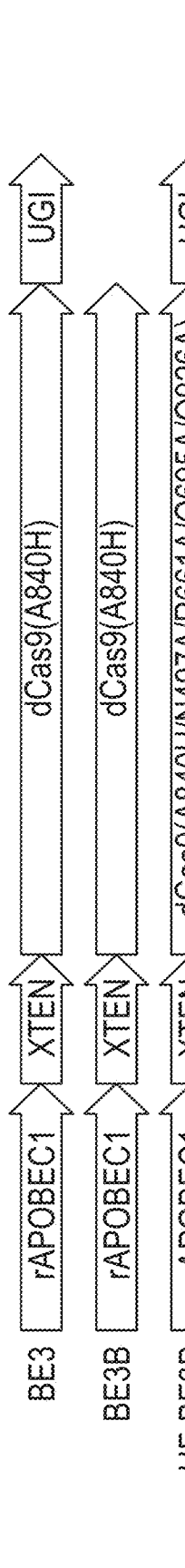

FIGS. 91A to 91B shows that use of a base editor with the nickase but without UGI leads to a mixture of outcomes, with very high indel rates.

Figures 92A, 92B:
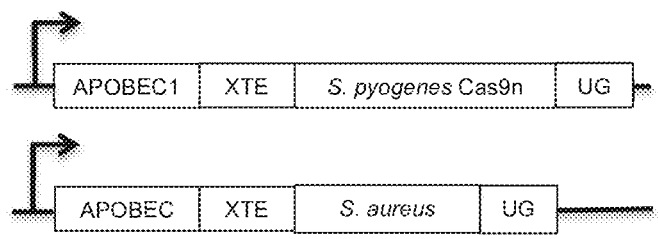
Figure 92C:
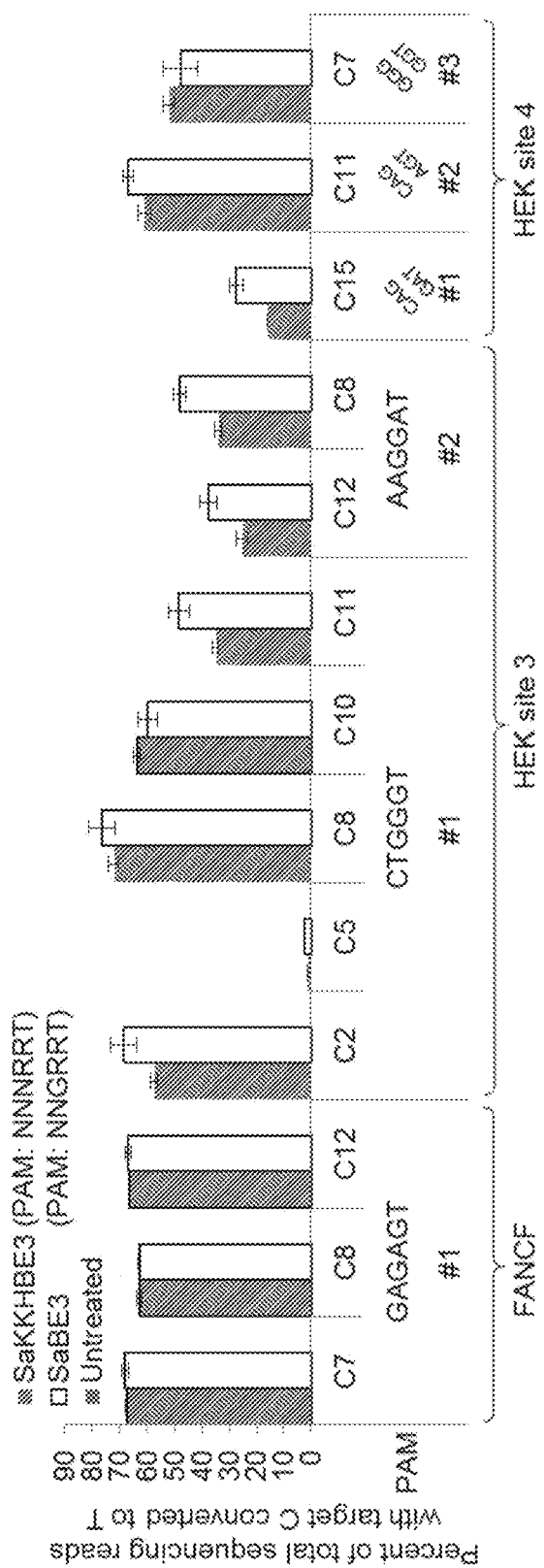
Figure 92D:
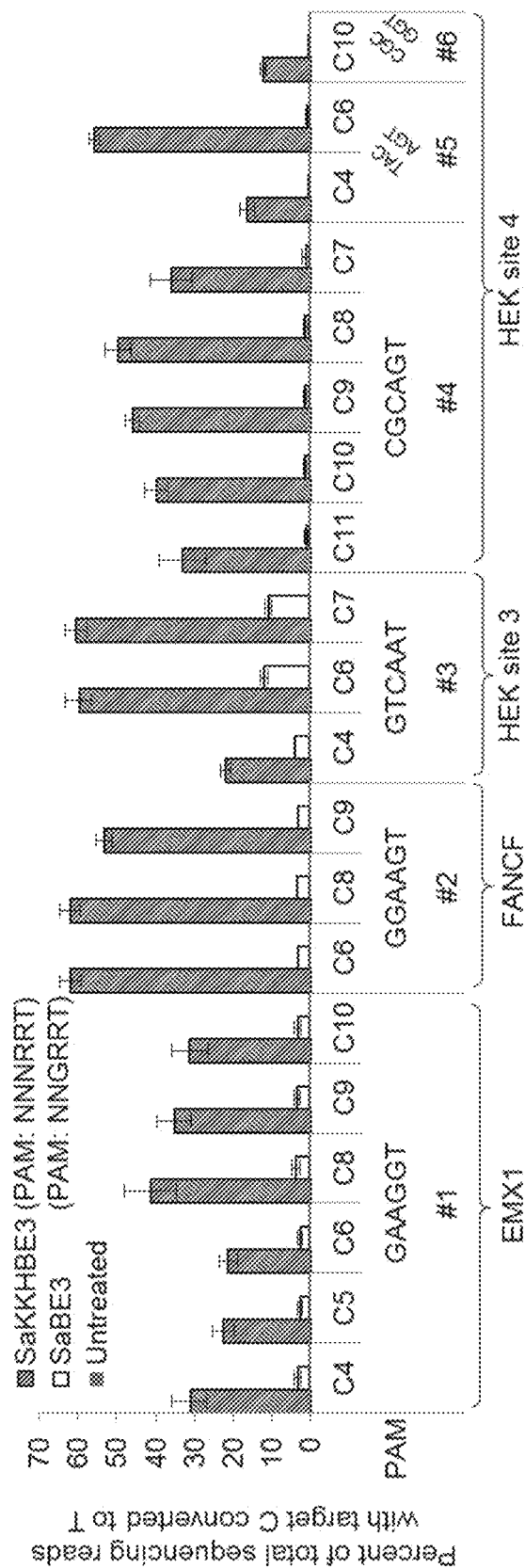
Figure 92E:
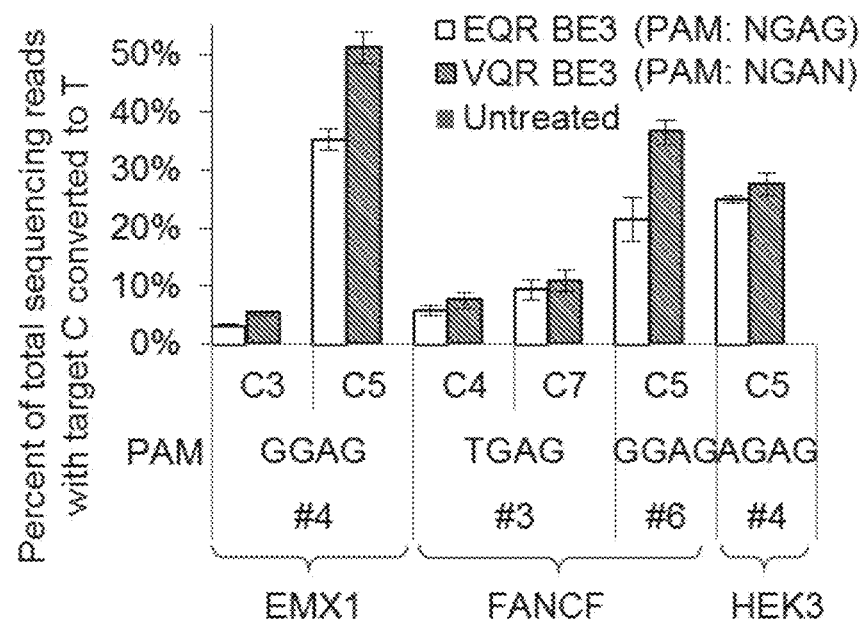
Figure 92F:
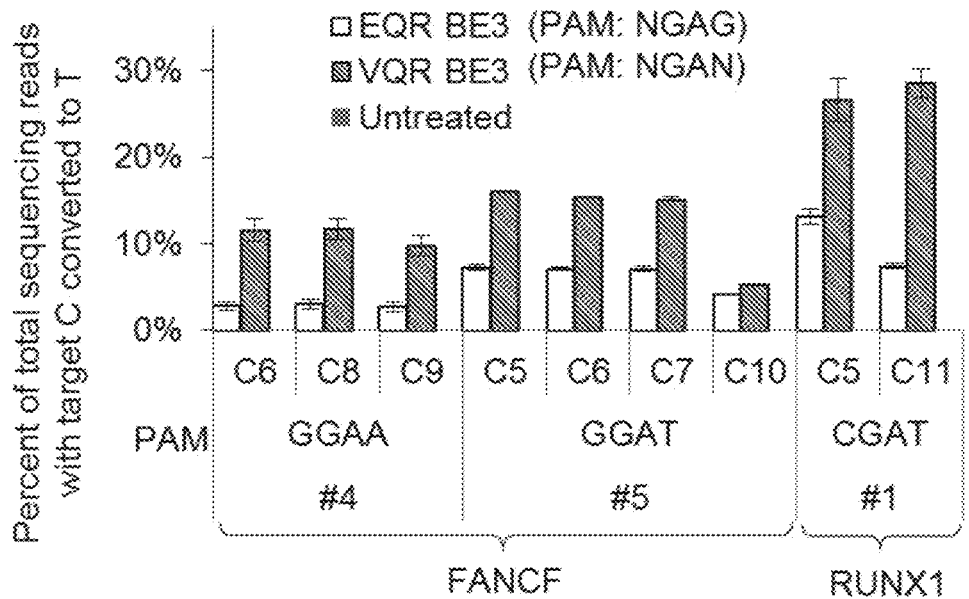
Figure 92G:
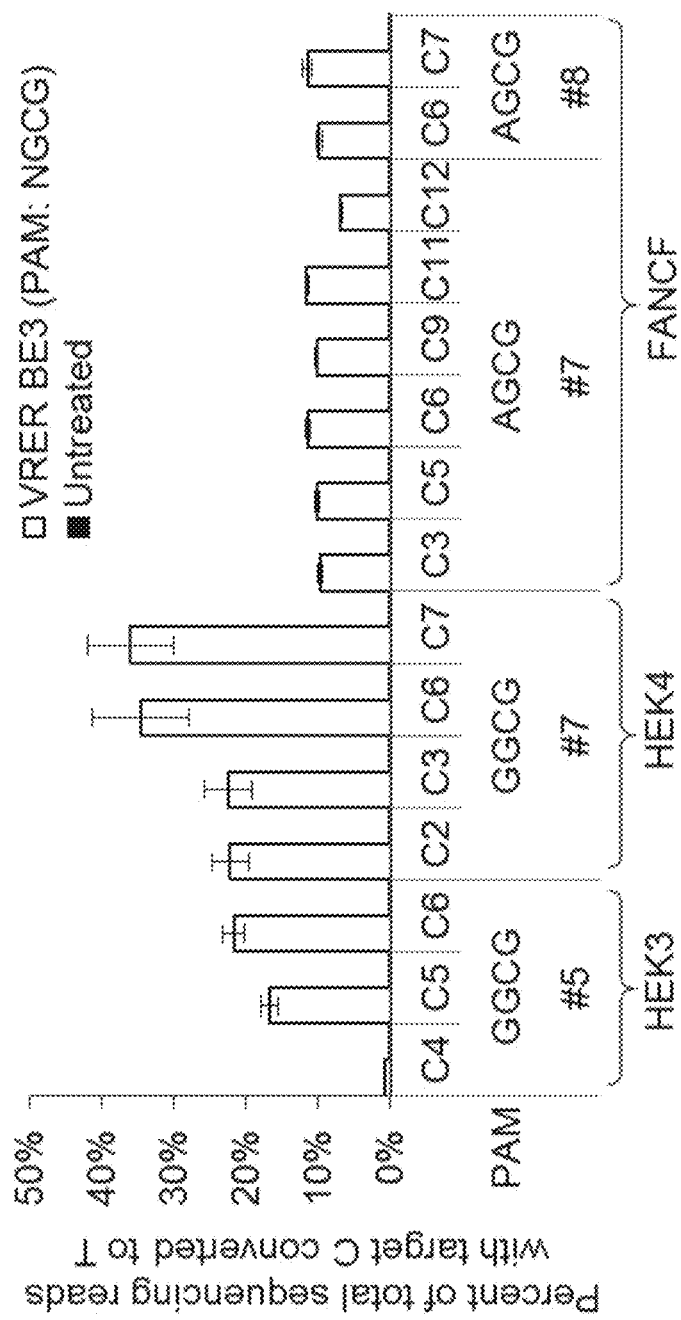

FIGS. 92A to 92G show that SaBE3, SaKKH-BE3, VQR-BE3, EQR-BE3, and VRER-BE3 mediate efficient base editing at target sites containing non-NGG PAMs in human cells. FIG. 92A shows base editor architectures using *S. pyogenes* and *S. aureus* Cas9. FIG. 92B shows recently characterized Cas9 variants with alternate or relaxed PAM requirements. FIGS. 92C and 92D show HEK293T cells treated with the base editor variants shown as described in Example 12. The percentage of total DNA sequencing reads (with no enrichment for transfected cells) with C converted to T at the target positions indicated are shown. The PAM sequence of each target tested is shown below the X-axis. The charts show the results for SaBE3 and SaKKH-BE3 at genomic loci with NNGRRT PAMs (FIG. 92C), SaBE3 and SaKKH-BE3 at genomic loci with NNNRRT PAMs (FIG. 92D), VQR-BE3 and EQR-BE3 at genomic loci with NGAG PAMs (FIG. 92E), and with NGAH PAMs (FIG. 92F), and VRER-BE3 at genomic loci with NGCG PAMs (FIG. 92G). Values and error bars reflect the mean and standard deviation of at least two biological replicates.

Figure 93A:
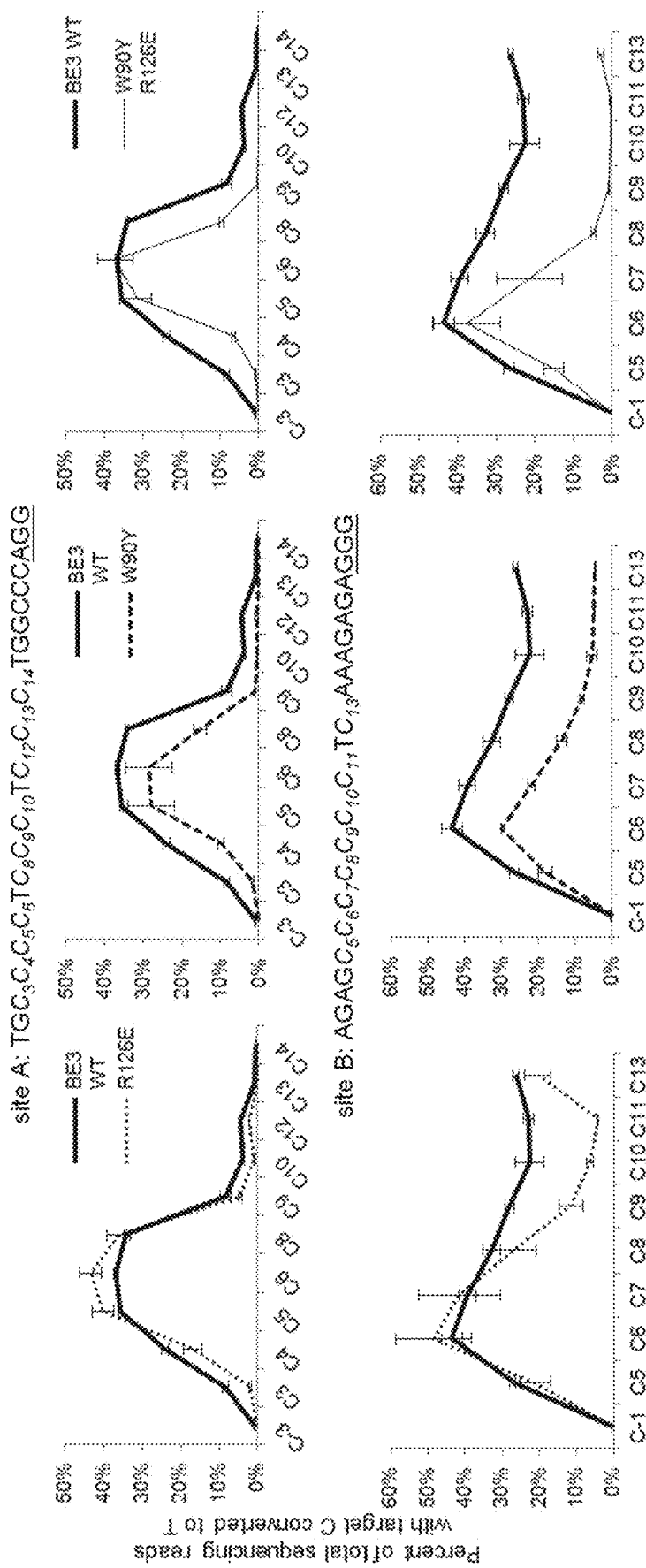
Figure 93B:
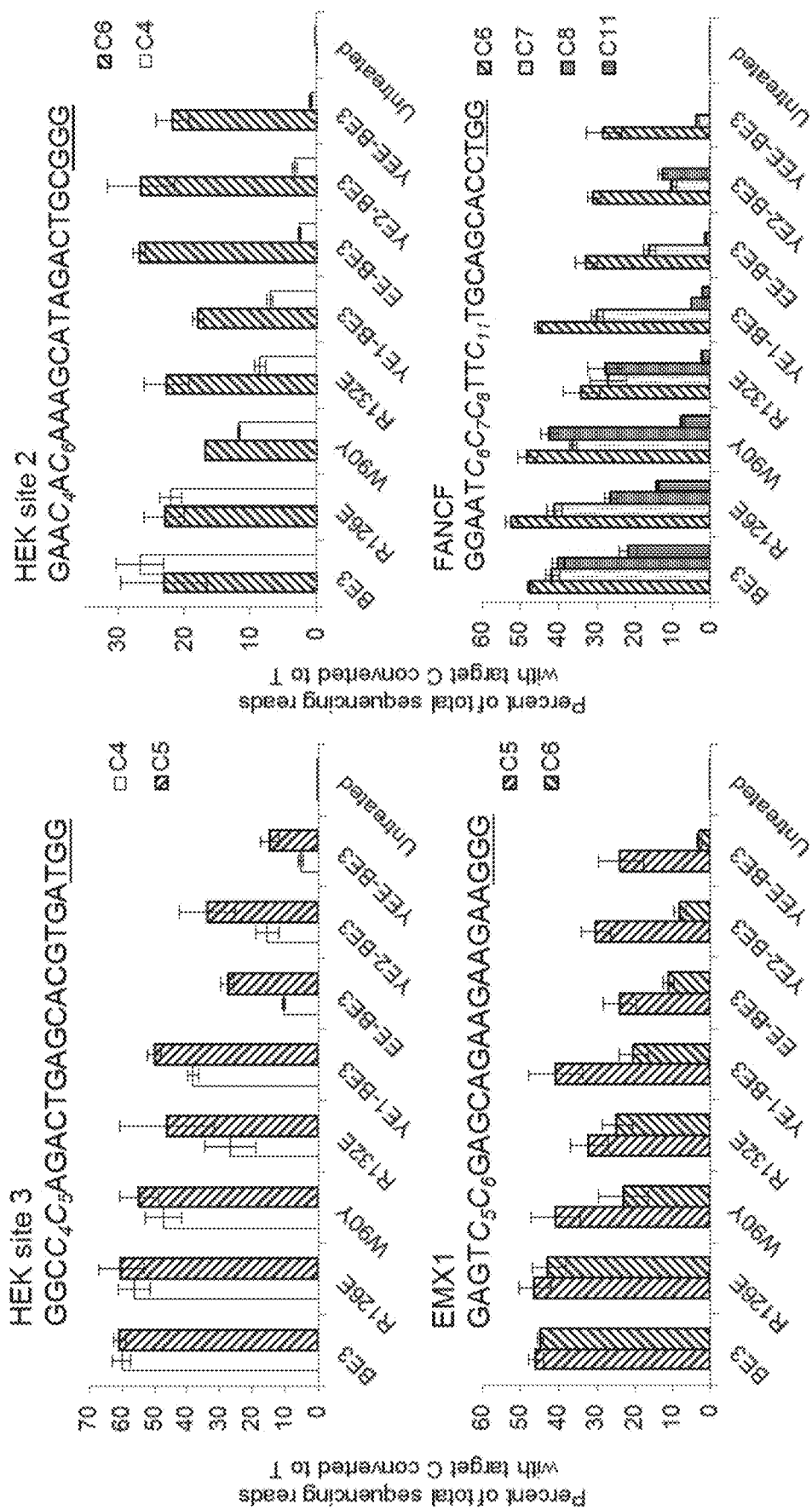
Figure 93C:
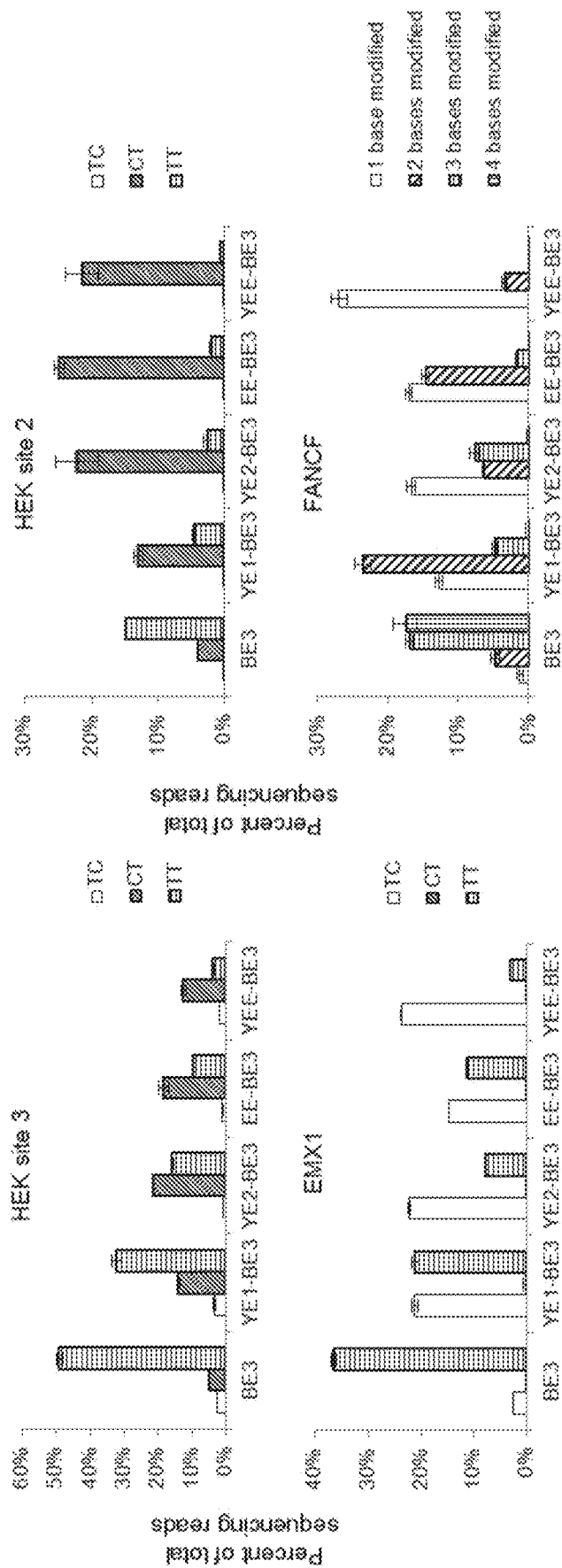

FIGS. 93A to 93C demonstrate that base editors with mutations in the cytidine deaminase domain exhibit narrowed editing windows. FIGS. 93A to 93C show HEK293T cells transfected with plasmids expressing mutant base editors and an appropriate sgRNA. Three days after transfection, genomic DNA was extracted and analyzed by high-throughput DNA sequencing at the indicated loci. The percentage of total DNA sequencing reads (without enrichment for transfected cells) with C changed to T at the target positions indicated are shown for the EMX1 site (SEQ ID NO: 721), HEK293 site 3 (SEQ ID NO: 719), FANCF site (SEQ ID NO: 722), HEK293 site 2 (SEQ ID NO: 720), site A (SEQ ID NO: 715), and site B (SEQ ID NO: 718) loci. FIG. 93A illustrates certain cytidine deaminase mutations which narrow the base editing window. See FIG. 98 for the characterization of additional mutations. FIG. 93B shows the effect of cytidine deaminase mutations which effect the editing window width on genomic loci. Combining beneficial mutations has an additive effect on narrowing the editing window. FIG. 93C shows that YE1-BE3, YE2-BE3, EE-BE3, and YEE-BE3 effect the product distribution of base editing, producing predominantly singly-modified products in contrast with BE3. Values and error bars reflect the mean and standard deviation of at least two biological replicates.

Figure 94A:
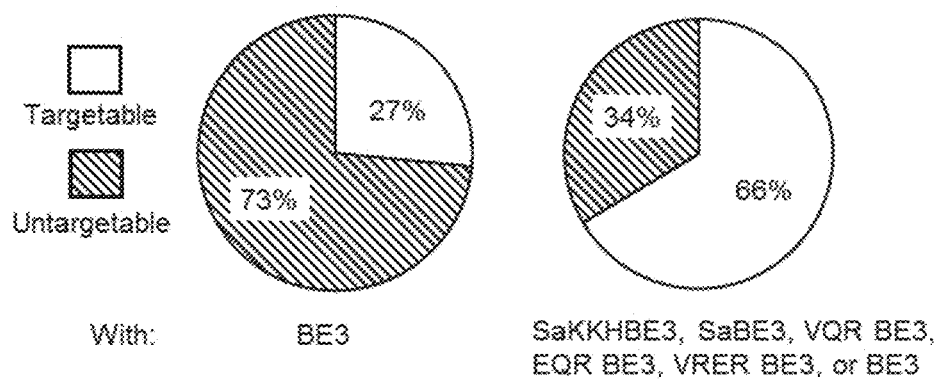
Figure 94B:

FIGS. 94A and 94B show genetic variants from ClinVar that in principle can be corrected by the base editors developed in this work. The NCBI ClinVar database of human genetic variations and their corresponding phenotypes was searched for genetic diseases that in theory can be corrected by base editing. FIG. 94A demonstrates improvement in base editing targeting scope among all pathogenic T→C mutations in the ClinVar database through the use of base editors with altered PAM specificities. The white fractions denote the proportion of pathogenic T→C mutations accessible on the basis of the PAM requirements of either BE3, or BE3 together with the five modified-PAM base editors developed in this work. FIG. 94B shows improvement in base editing targeting scope among all pathogenic T→C mutations in the ClinVar database through the use of base editors with narrowed activity windows. BE3 was assumed to edit Cs in positions 4-8 with comparable efficiency as shown in FIGS. 93A to 93C. YEE-BE3 was assumed to edit with C5>C6>C7>others preference within its activity window. The white fractions denote the proportion of pathogenic T→C mutations that can be edited BE3 without comparable editing of other Cs (left), or that can be edited BE3 or YEE-BE3 without comparable editing of other Cs (right).

Figure 95A:
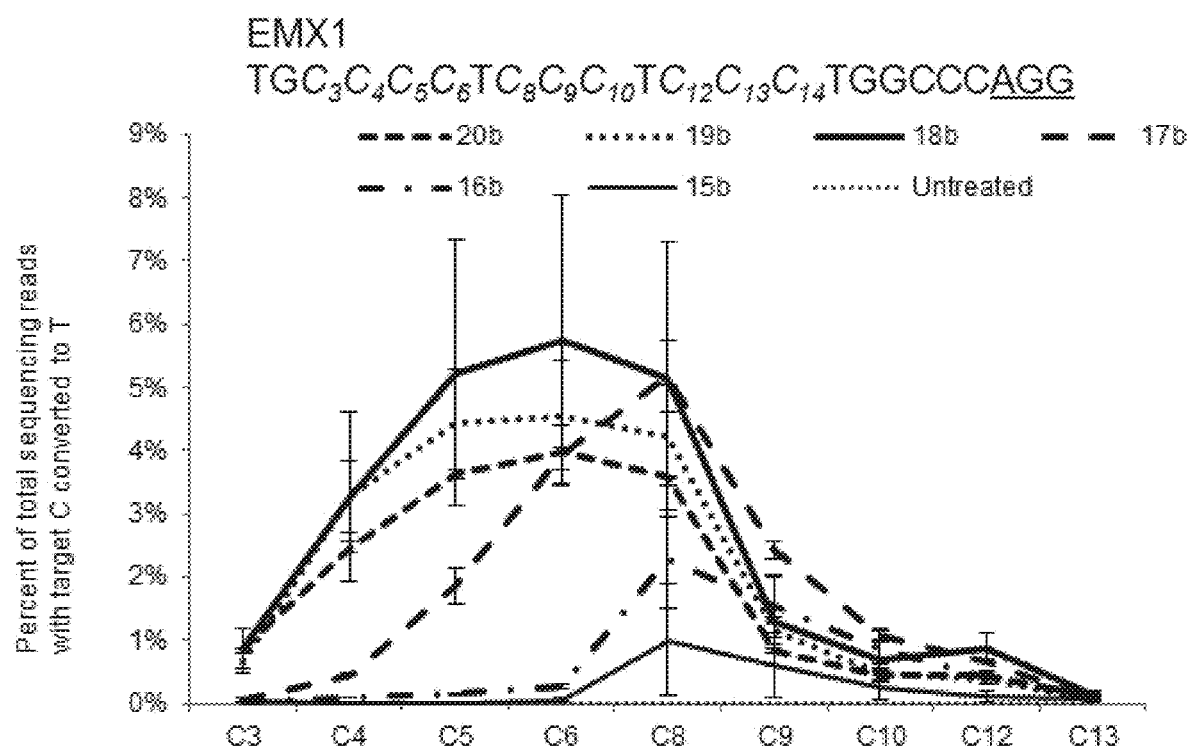
Figure 95B:
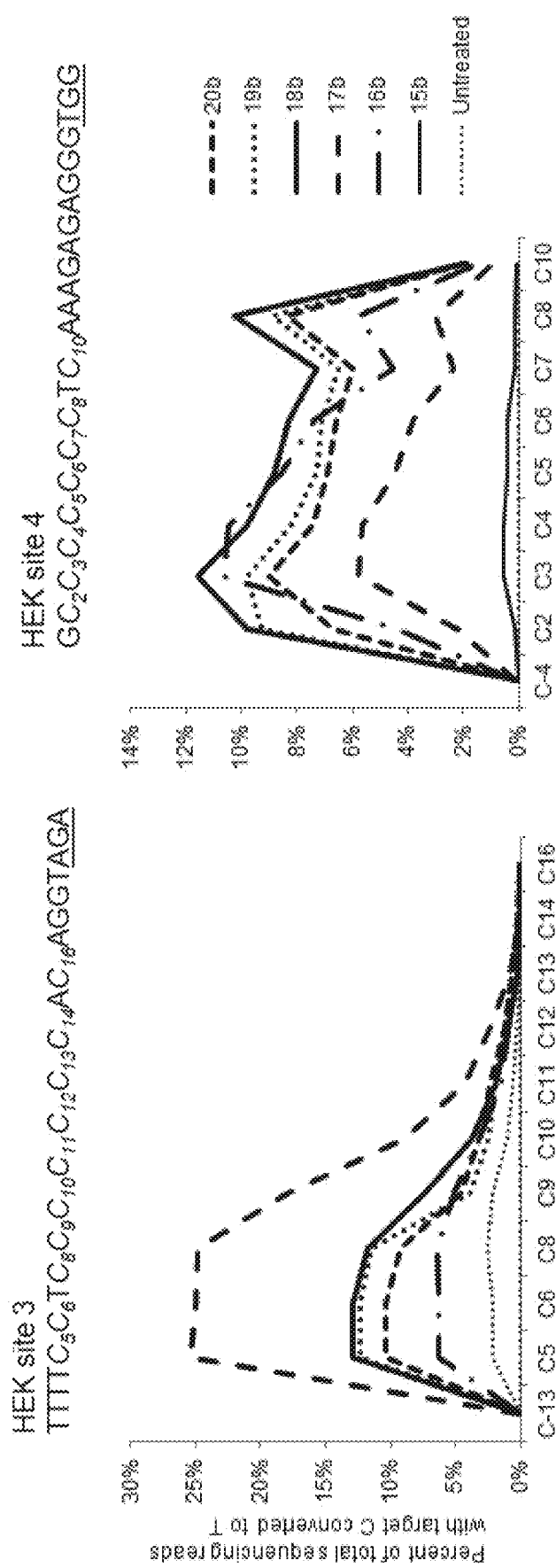

FIGS. 95A to 95B show the effect of truncated guide RNAs on base editing window width. HEK293T cells were transfected with plasmids expressing BE3 and sgRNAs of different 5' truncation lengths. The treated cells were analyzed as described in the Examples. FIG. 95A shows protospacer and PAM sequence (top, SEQ ID NO: 715) and cellular C to T conversion percentages, defined as the percentage of total DNA sequencing reads with Ts at the target positions indicated, at a site within the EMX1 genomic locus. At this site, the base editing window was altered through the use of a 17-nt truncated gRNA. FIG. 95B shows protospacer and PAM sequences (top, SEQ ID NOs: 716 and 717) and cellular C to T conversion percentages, defined as the percentage of total DNA sequencing reads with Ts at the target positions indicated, at sites within the HEK site 3 and site 4 genomic loci. At these sites, no change in the base editing window was observed, but a linear decrease in editing efficiency for all substrate bases as the sgRNA is truncated was noted.

FIG. 96 shows the effect of APOBEC1-Cas9 linker lengths on base editing window width. HEK293T cells were transfected with plasmids expressing base editors with rAPOBEC1-Cas9 linkers of XTEN, GGS, (GGS)$_3$ (SEQ ID NO: 610), (GGS)$_5$ (SEQ ID NO: 610), or (GGS)$_7$ (SEQ ID NO: 610) and an sgRNA. The treated cells were analyzed as described in the Examples. Cellular C to T conversion percentages, defined as the percentage of total DNA sequencing reads with Ts at the target positions indicated, are shown for the various base editors with different linkers.

Figure 97C:
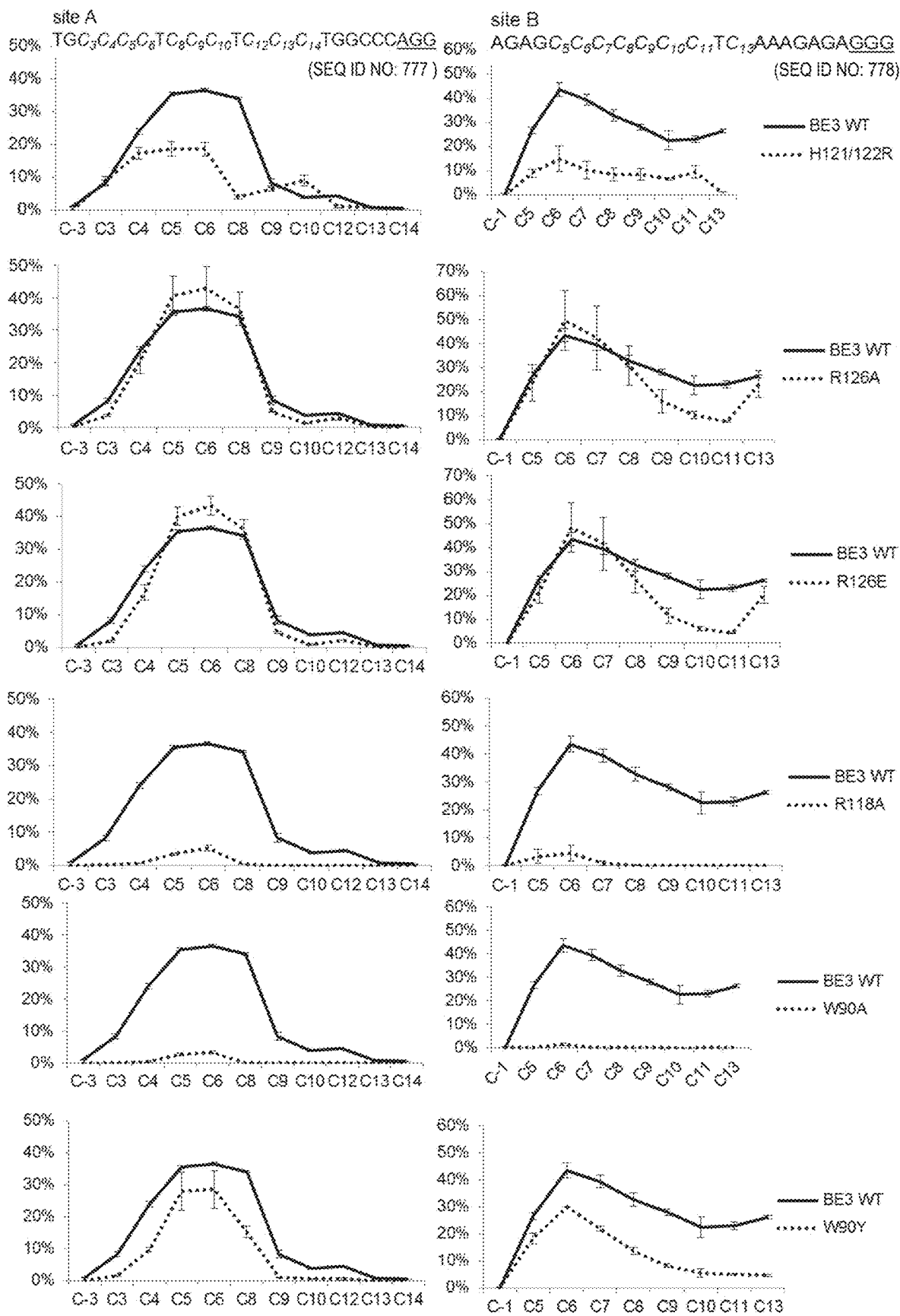
Figure 97D:
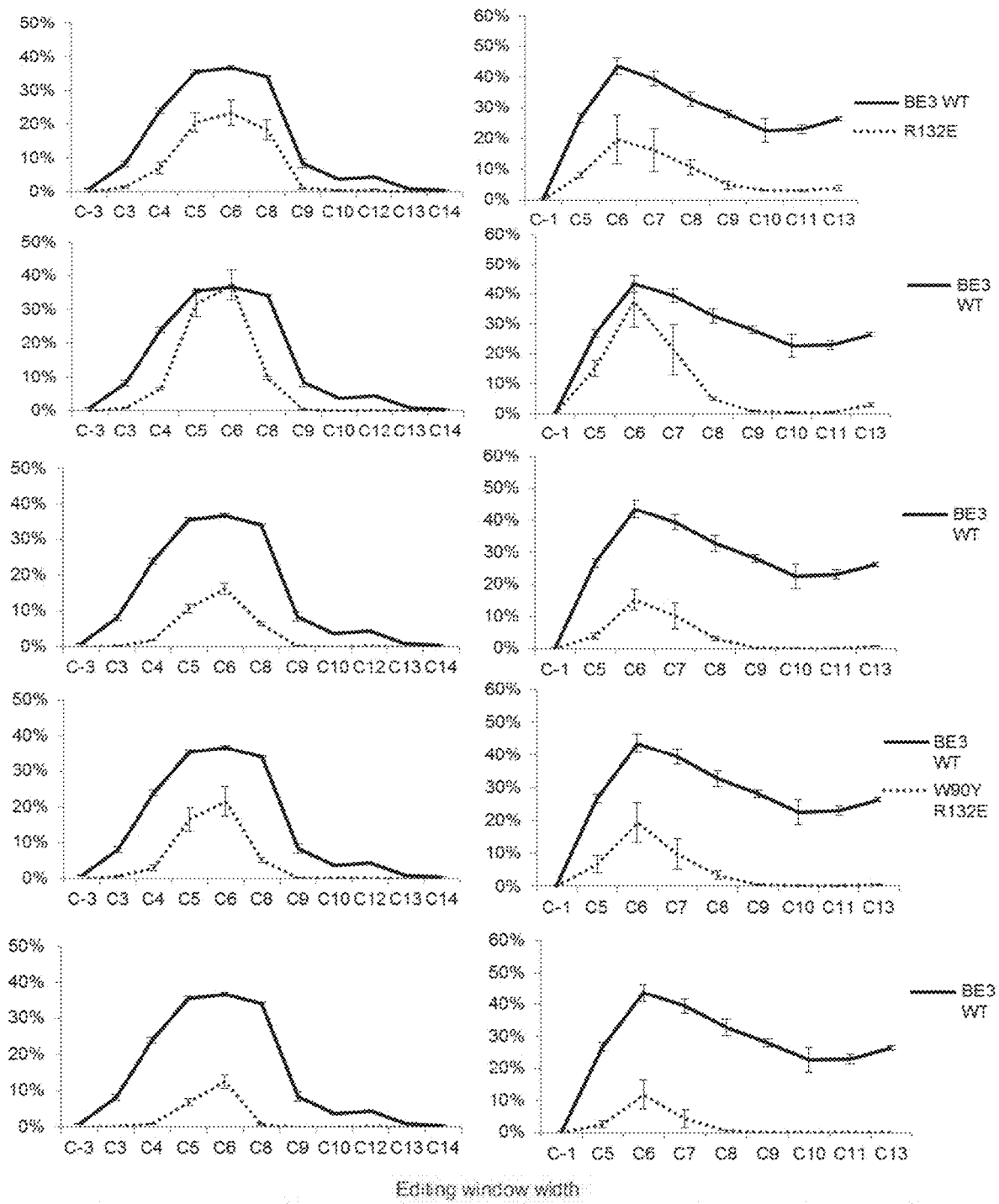

FIGS. 97A to 97C show the effect of rAPOBEC mutations on base editing window width. FIG. 97C to 97D shows HEK293T cells transfected with plasmids expressing an sgRNA targeting either Site A or Site B and the BE3 point mutants indicated. The treated cells were analyzed as described in the Examples. All C's in the protospacer and within three basepairs of the protospacer are displayed and the cellular C to T conversion percentages are shown. The 'editing window widths', defined as the calculated number of nucleotides within which editing efficiency exceeds the half-maximal value, are displayed for all tested mutants.

Figure 98:
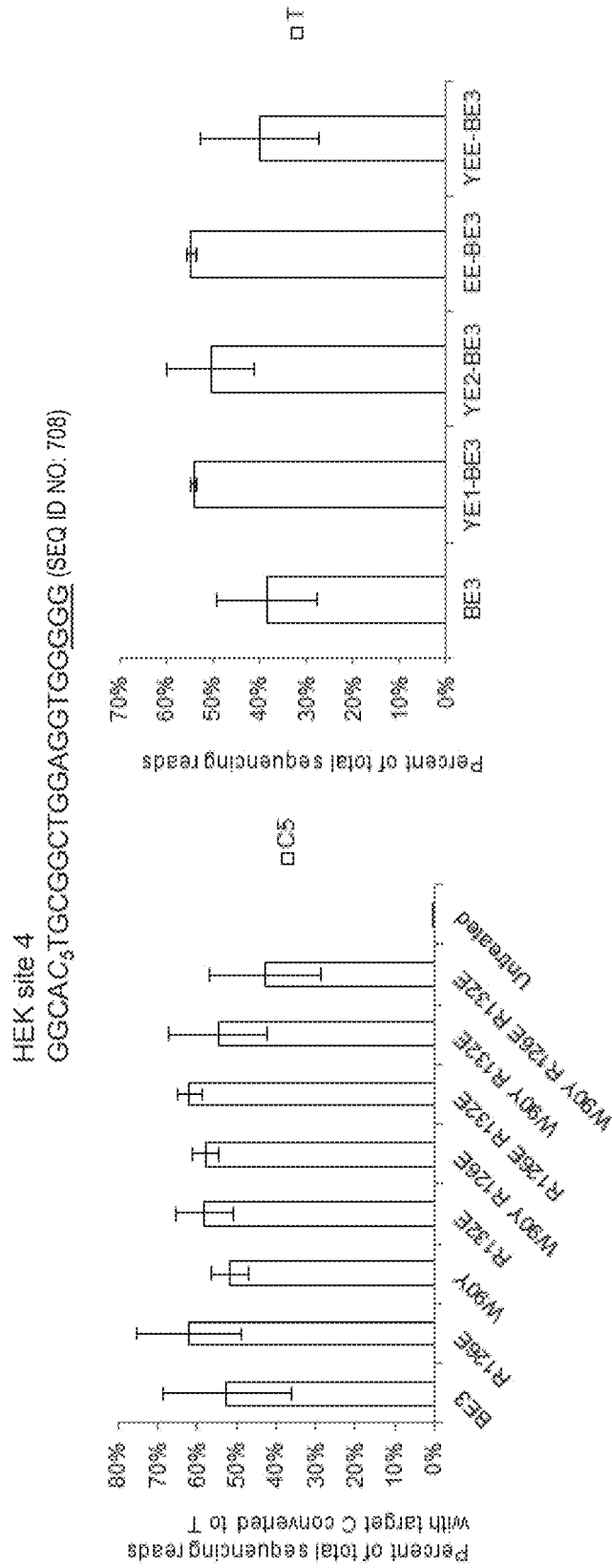

FIG. 98 shows the effect of APOBEC1 mutation son product distributions of base editing in mammalian cells. HEK293T cells were transfected with plasmids expressing BE3 or its mutants and an appropriate sgRNAs. The treated cells were analyzed as described in the Examples. Cellular C to T conversion percentages, defined as the percentage of total DNA sequencing reads with Ts at the target positions indicated, are shown (left). Percent of total sequencing reads containing the C to T conversion is shown on the right. The BE3 point mutants do not significantly affect base editing efficiencies at HEK site 4, a site with only one target cytidine.

Figure 99:
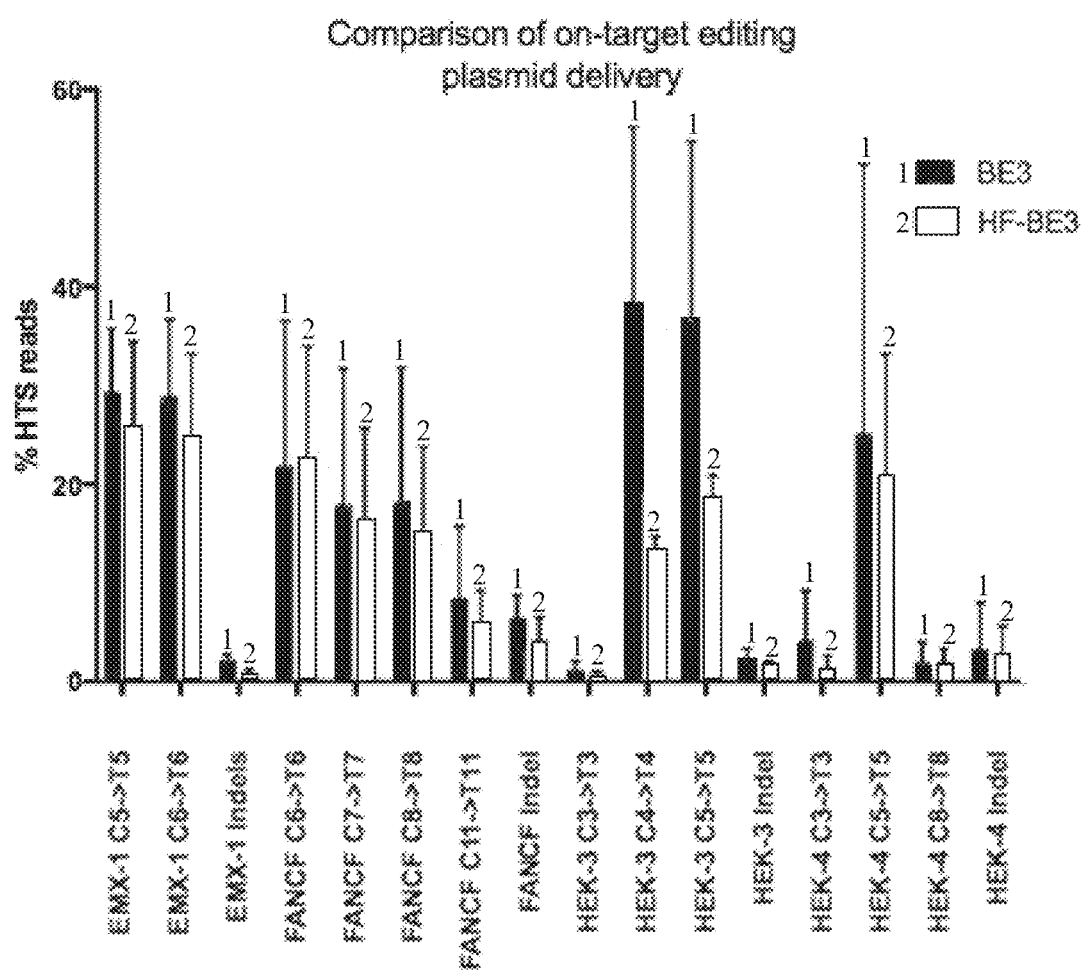

FIG. 99 shows a comparison of on-target editing plasma delivery in BE3 and HF-BE3.

Figure 100:
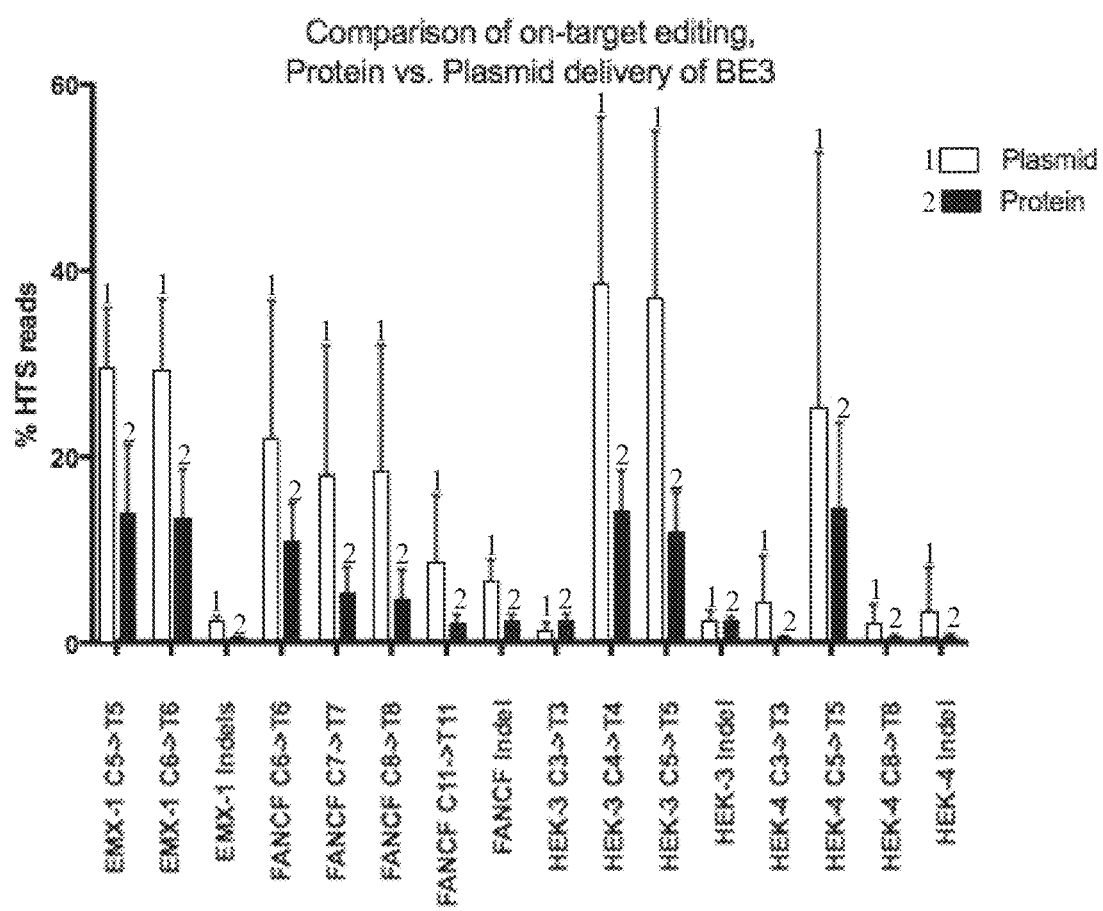

FIG. 100 shows a comparison of on-target editing in protein and plasma delivery of BE3.

Figure 101:
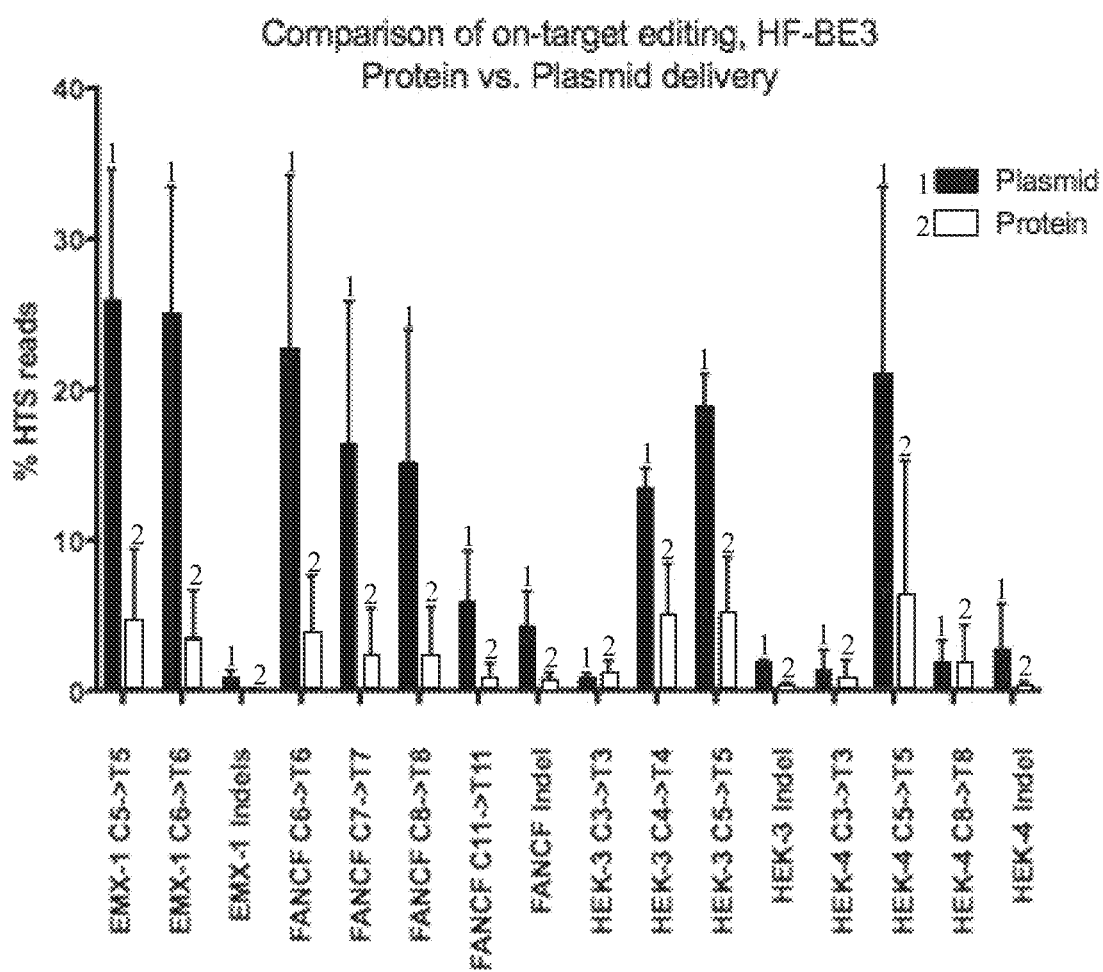

FIG. 101 shows a comparison of on-target editing in protein and plasma delivery of HF-BE3.

Figure 102:
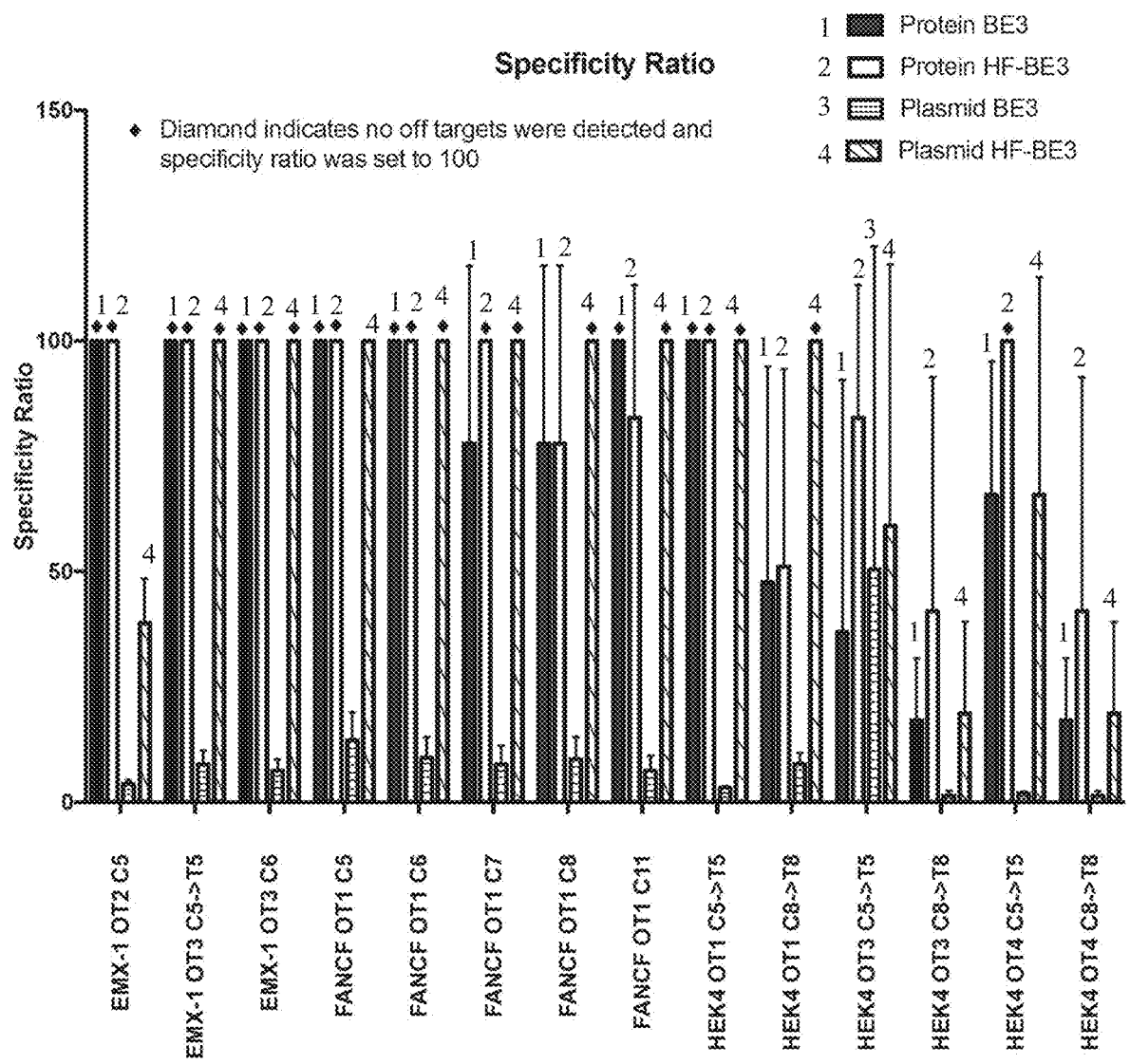

FIG. 102 shows that both lipofection and installing HF mutations decrease off-target deamination events. The diamond indicates no off targets were detected and the specificity ratio was set to 100.

Figure 103:
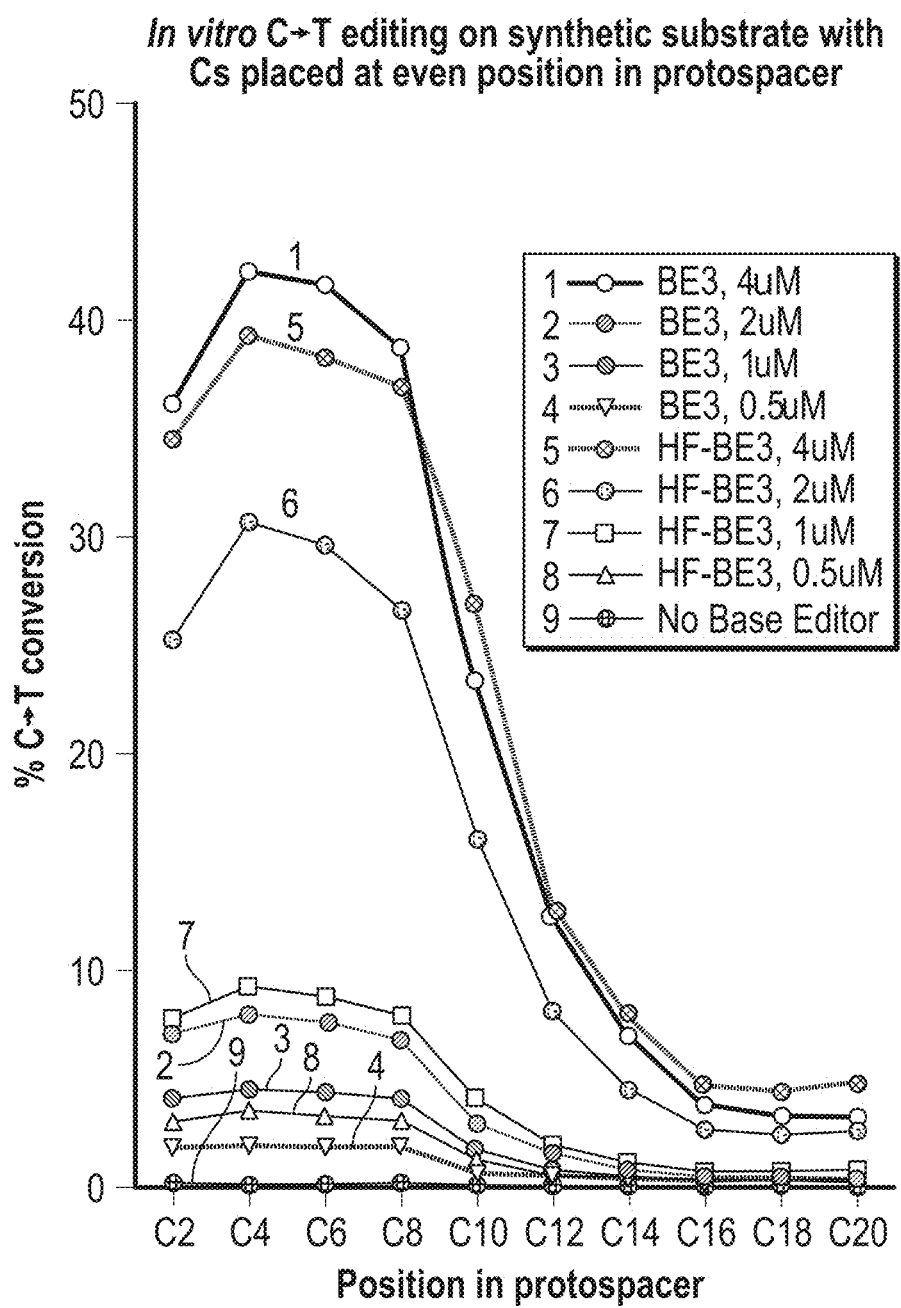

FIG. 103 shows in vitro C to T editing on a synthetic substrate with Cs placed at even positions in the protospacer (NNNNTC$_2$TC$_4$TC$_6$TC$_8$TC$_{10}$TC$_{12}$TC$_{14}$TC$_{16}$TC$_{18}$TC$_{20}$NGG, SEQ ID NO: 723).

Figure 104:
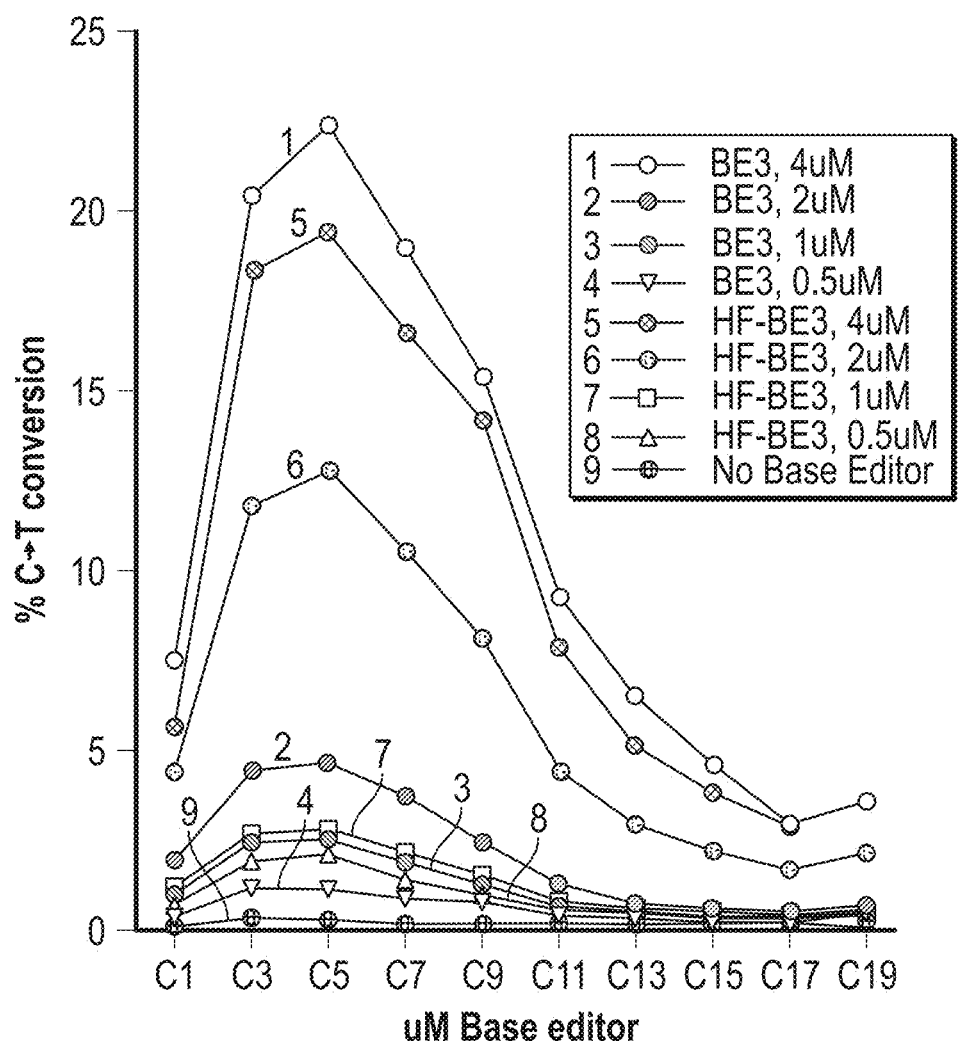

FIG. 104 shows in vitro C to T editing on a synthetic substrate with Cs placed at odd positions in the protospacer (NNNNTC$_2$TC$_4$TC$_6$TC$_8$TC$_{10}$TC$_{12}$TC$_{14}$TC$_{16}$TC$_{18}$TC$_{20}$NGG, SEQ ID NO: 723).

Figure 105:
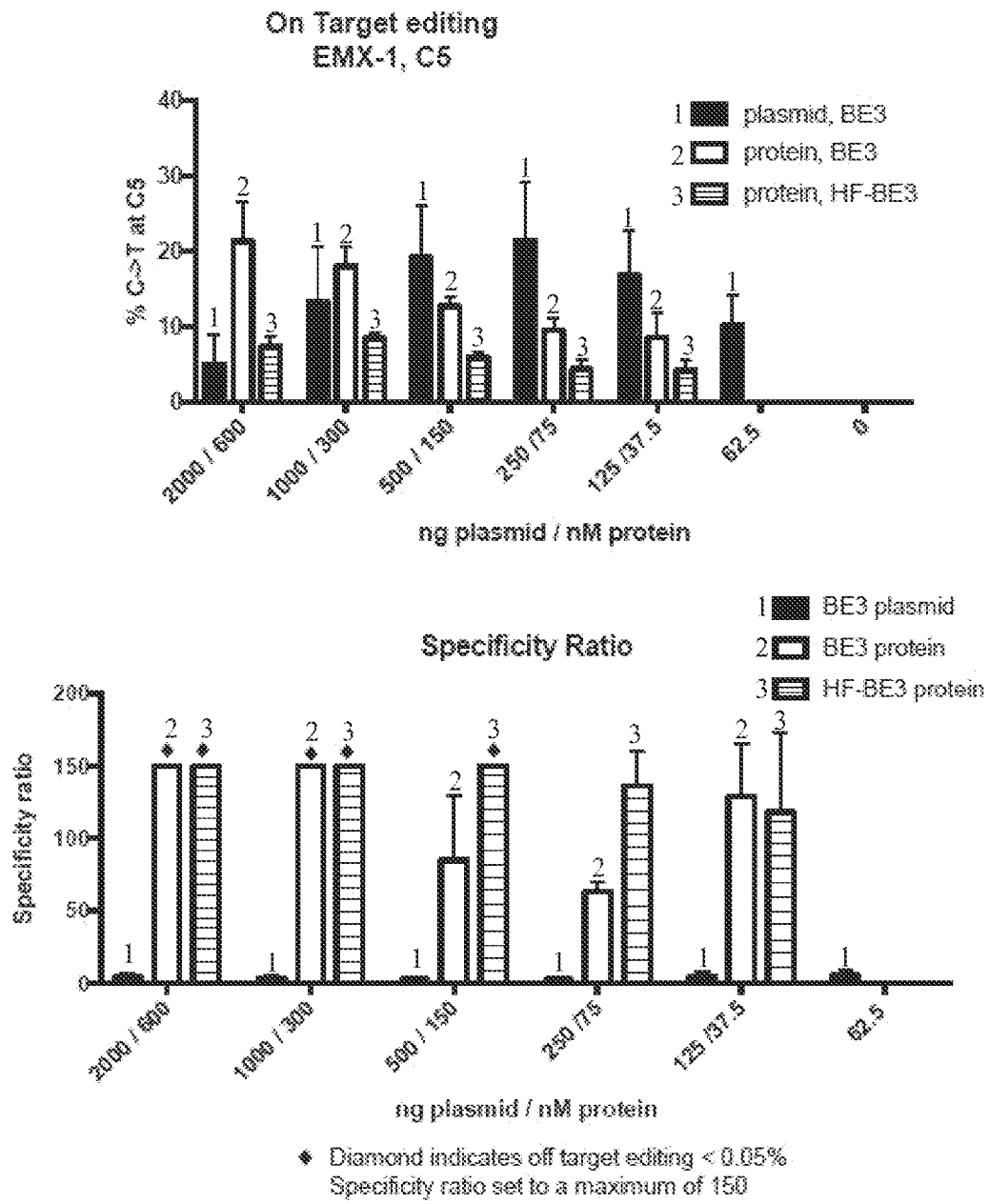

FIG. 105 includes two graphs depicting the specificity ratio of base editing with plasmid vs. protein delivery.

Figure 106A:
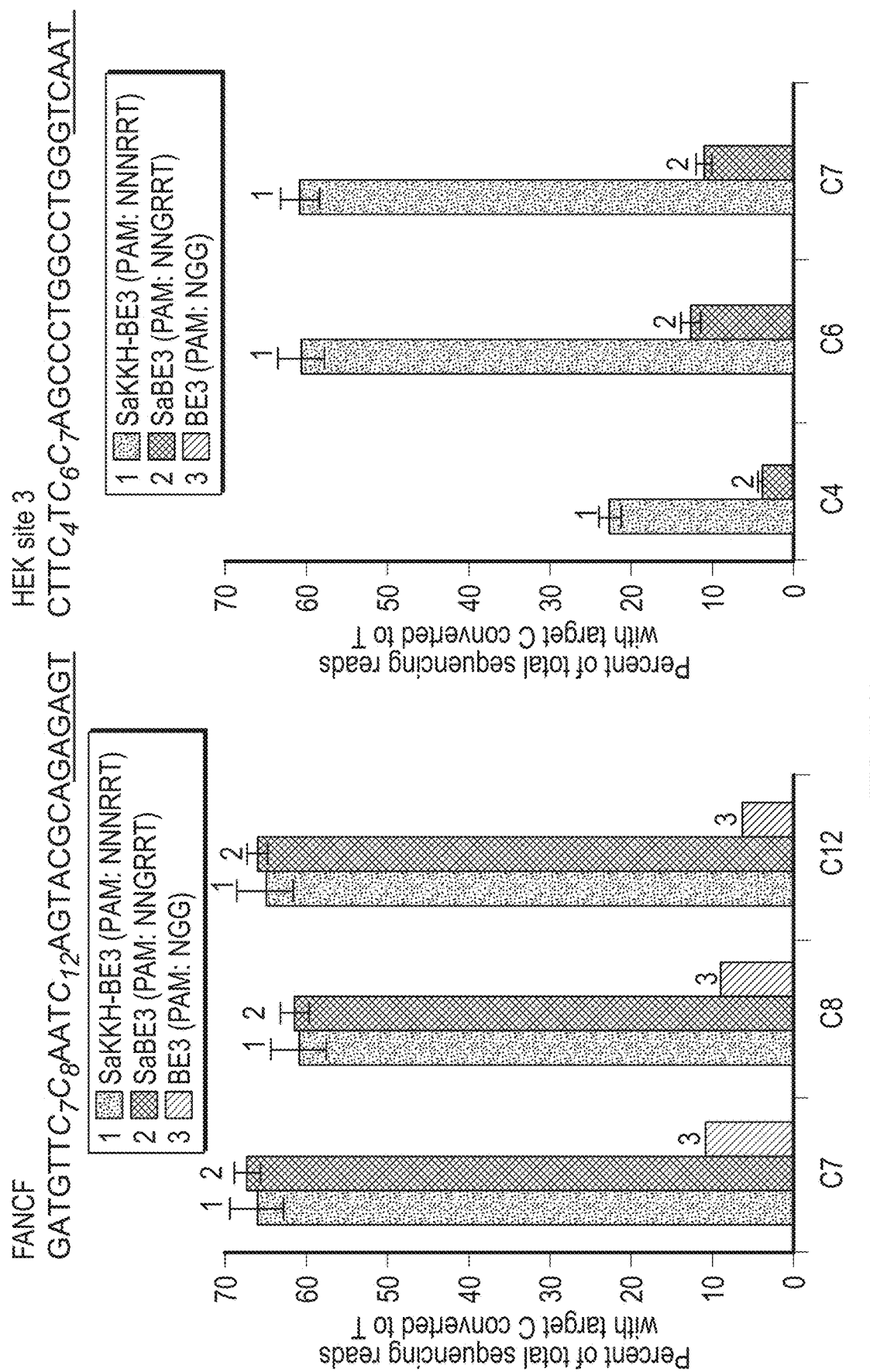
Figure 106B:
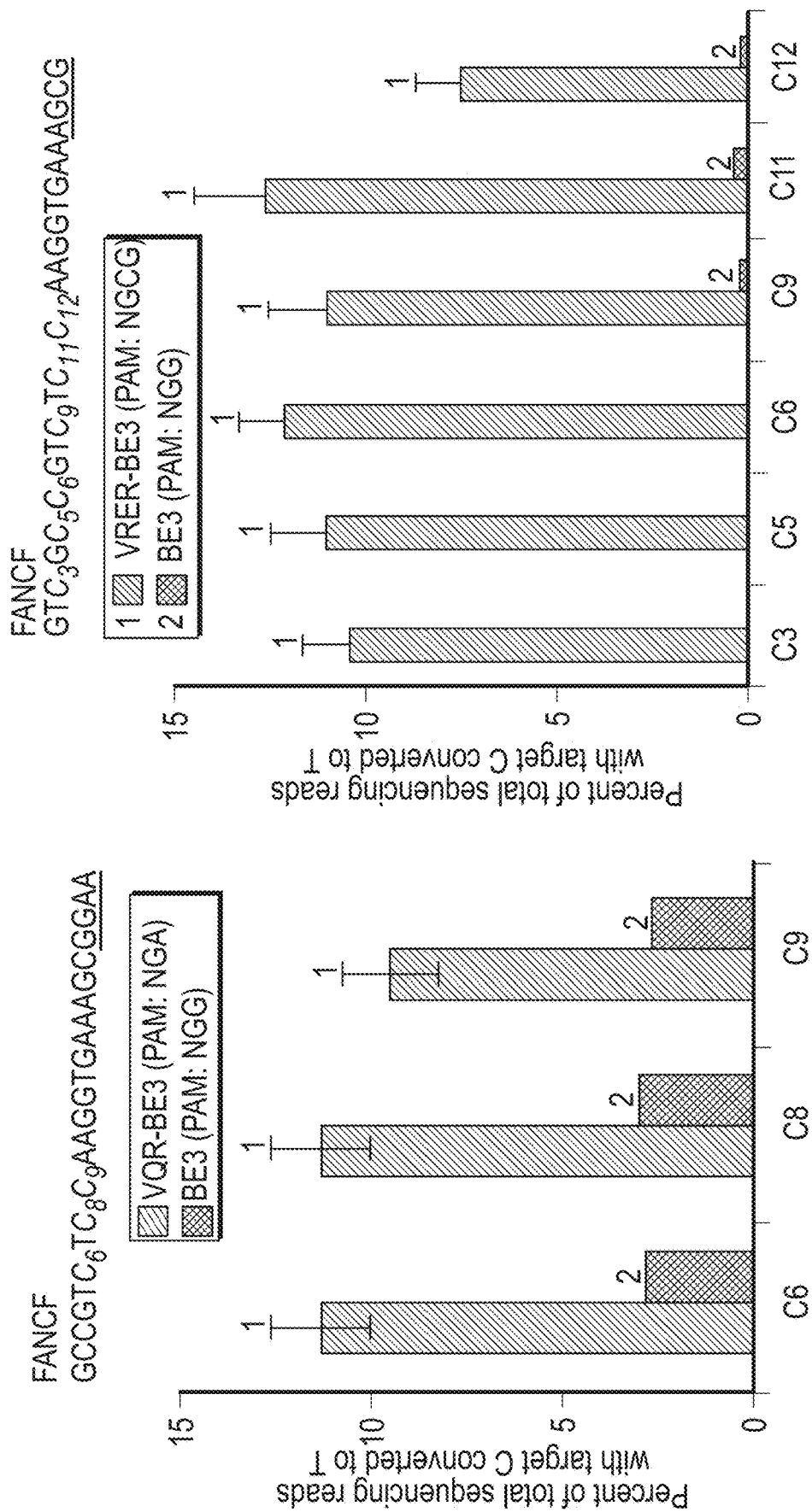

FIGS. 106A to 106B shows BE3 activity on non-NGG PAM sites. HEK293T cells were transfected with plasmids expressing BE3 and appropriate sgRNA. The treated cells were analyzed as described in the Examples. FIG. 106A shows BE3 activity on sites can be efficiently targeted by SaBE3 or SaKKH-BE3. BE3 shows low but significant activity on the NAG PAM. This figure depicts SEQ ID NOs: 728 and 729. FIG. 106B shows BE3 has significantly reduced editing at sites with NGA or NGCG PAMs, in contrast to VQR-BE3 or VRER-BE3. This figure depicts SEQ ID NOs: 730 and 731.

Figure 107A:
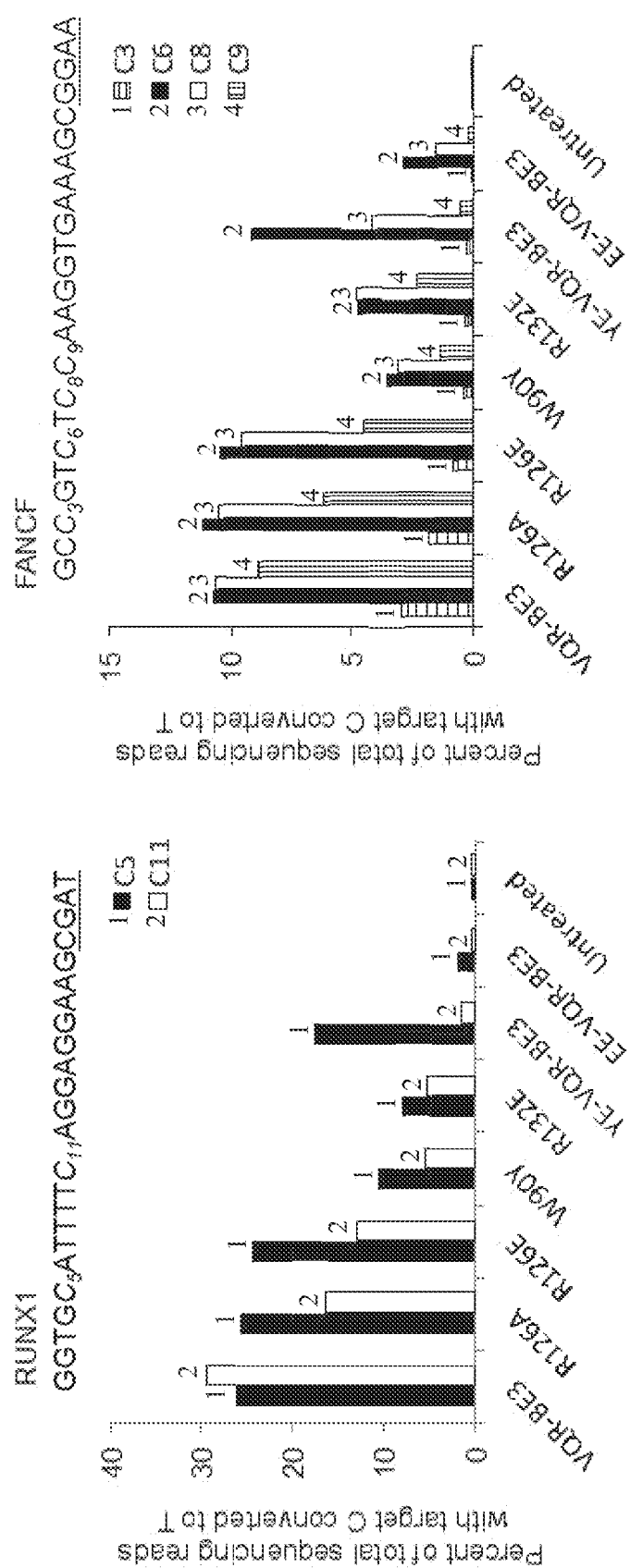
Figure 107B:
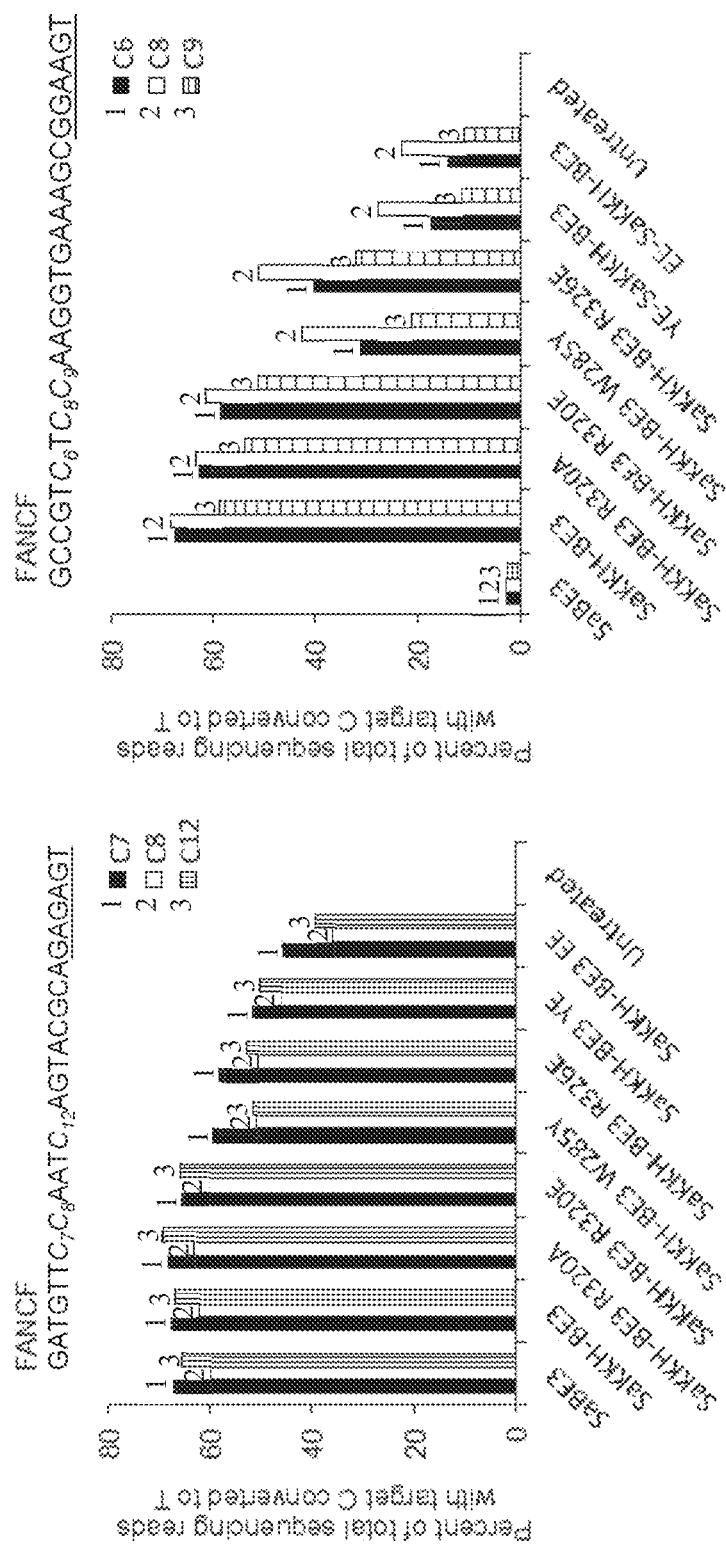

FIGS. 107A to 107B show the effect of APOBEC1 mutations on VQR-BE3 and SaKKH-BE3. HEK293T cells were transfected with plasmids expressing VQR-BE3, SaKKH-BE3 or its mutants and an appropriate sgRNAs. The treated cells were analyzed as described in the Examples below. Cellular C to T conversion percentages, defined as the percentage of total DNA sequencing reads with Ts at the target positions indicated, are shown. FIG. 107A shows that the window-modulating mutations can be applied to VQR-BE3 to enable selective base editing at sites targetable by NGA PAM. This figure depicts SEQ ID NOs: 732 and 733. FIG. 107B shows that, when applied to SaKKH-BE3, the mutations cause overall decrease in base editing efficiency without conferring base selectivity within the target window. This figure depicts SEQ ID NOs: 728 and 734.

Figure 108:
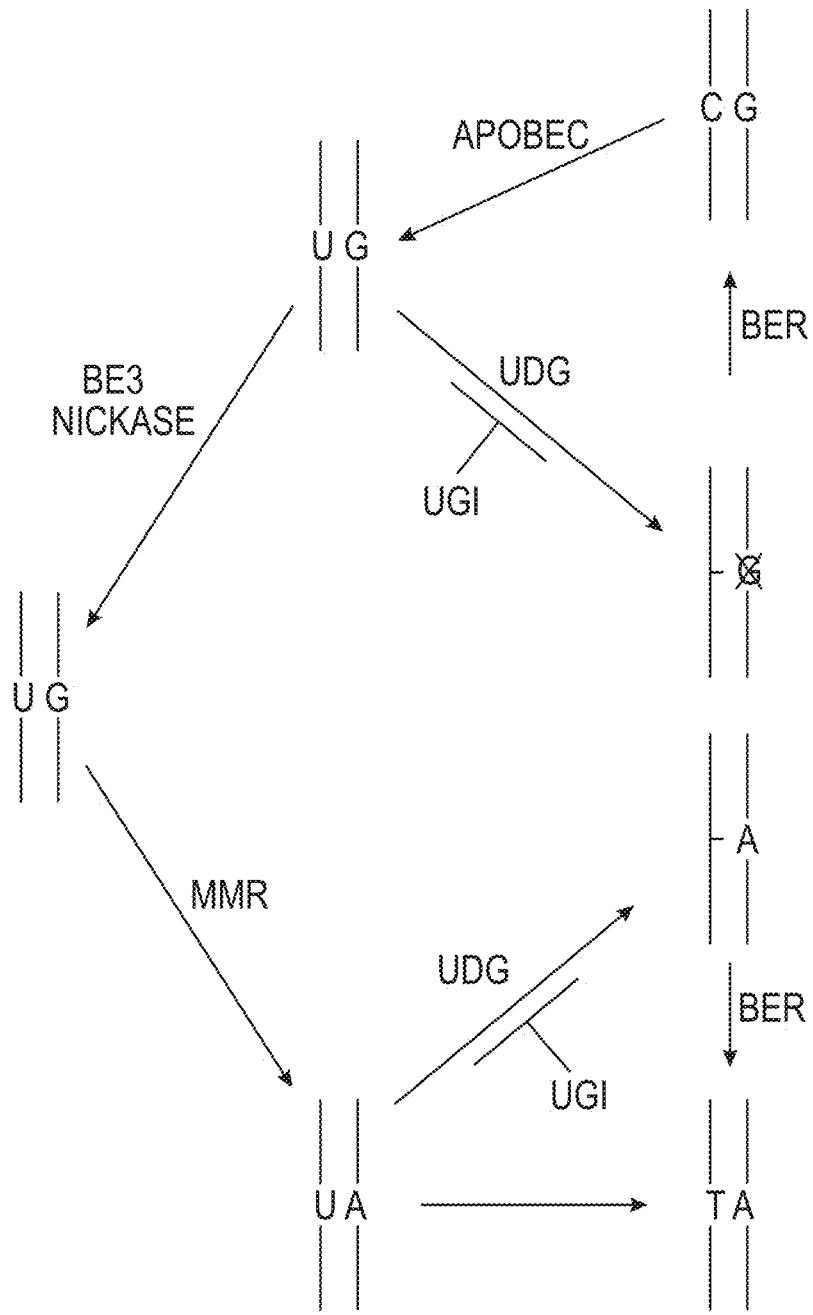

FIG. 108 shows a schematic representation of nucleotide editing. The following abbreviations are used: (MMR)—mismatch repair, (BE3 Nickase)—refers to base editor 3, which comprises a Cas9 nickase domain, (UGI)—uracil glycosylase inhibitor, (UDG)—uracil DNA glycosylase, (APOBEC)—refers to an APOBEC cytidine deaminase.

Figure 109:
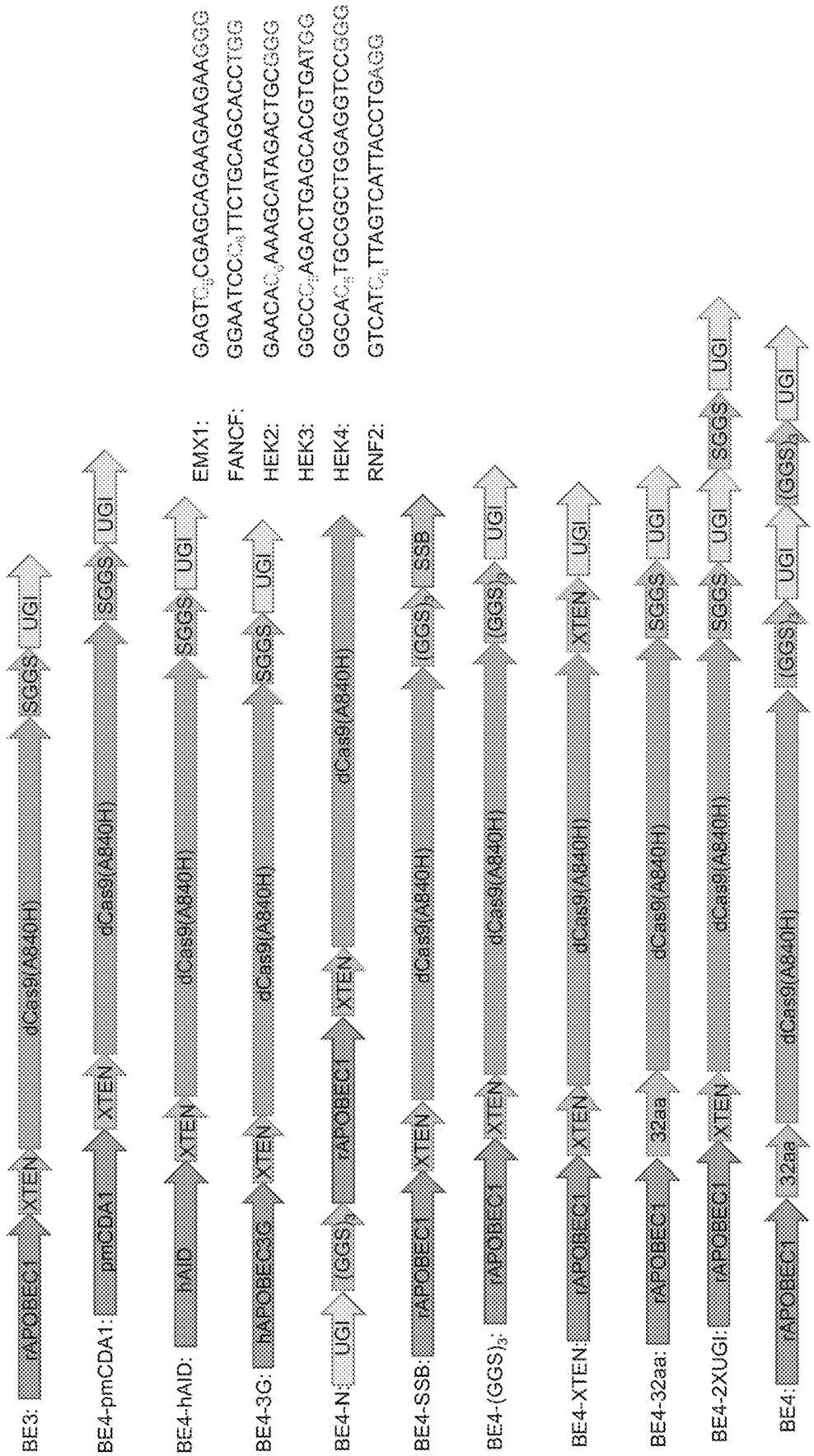

FIG. 109 shows schematic representations of exemplary base editing constructs. The structural arrangement of base editing constructs is shown for BE3, BE4-pmCDA1, BE4-hAID, BE4-3G, BE4-N, BE4-SSB, BE4-(GGS)$_3$, BE4-XTEN, BE4-32aa, BE4-2xUGI, and BE4. Linkers are shown in grey (XTEN, SGGS (SEQ ID NO: 606), (GGS)$_3$ (SEQ ID NO: 610), and 32aa). Deaminases are shown (rAPOBEC1, pmCDA1, hAID, and hAPOBEC3G). Uracil DNA Glycosylase Inhibitor (UGI) is shown. Single-stranded DNA binding protein (SSB) is shown in purple. Cas9 nickase, dCas9(A840H), is shown in red. FIG. 109 also shows the following target sequences: EMX1, FANCF, HEK2, HEK3, HEK4, and RNF2. The amino acid sequences are indicated in SEQ ID NOs: 127-132 from top to bottom. The PAM sequences are the last three nucleotides. The target cytosine (C) is numbered and indicated in red.

FIG. 110 shows the base editing results for the indicated base editing constructs (BE3, pmCDA1 hAID, hAPOBEC3G, BE4-N, BE4-SSB, BE4-(GGS)$_3$, BE-XTEN, BE4-32aa, and BE4-2xUGI) on the targeted cytokine (C$_5$) of the EMX1 sequence, GAGTC$_5$CGAGCAGA-AGAAGAAGGG (SEQ ID NO: 127). The total percentage of targeted cytosines (C$_5$) that were mutated is indicated for each base editing construct, under "C$_5$". The total percentage of indels is indicated for each base editing construct, under "indel". The proportion of mutated cytosines that were mutated to an adenine (A), guanine (G), or thymine (T) are indicated for each base editing construct in the pie chart.

FIG. 111 shows the base editing results for the indicated base editing constructs (BE3, pmCDA1 hAID, hAPOBEC3G, BE4-N, BE4-SSB, BE4-(GGS)$_3$, BE-XTEN, BE4-32aa, and BE4-2xUGI) on the targeted cytokine (C$_8$) of the FANCF sequence, GGAATCCC$_8$TTCTGCA-GCACCTGG (SEQ ID NO: 128). The total percentage of targeted cytosines (C$_8$) that were mutated are indicated for each base editing construct, under "C$_8$". The total percentage of indels are indicated for each base editing construct, under "indel". The proportion of mutated cytosines that were mutated to an adenine (A), guanine (G), or thymine (T) are indicated for each base editing construct in the pie chart.

FIG. 112 shows the base editing results for the indicated base editing constructs (BE3, pmCDA1 hAID, hAPOBEC3G, BE4-N, BE4-SSB, BE4-(GGS)$_3$, BE-XTEN, BE4-32aa, and BE4-2xUGI) on the targeted cytokine (C6) of the HEK2 sequence, GAACAC$_6$AAAGCATA-GACTGCGGG (SEQ ID NO: 129). The total percentage of targeted cytosines (C$_6$) that were mutated are indicated for each base editing construct, under "C$_6$". The total percentage of indels are indicated for each base editing construct, under "indel". The proportion of mutated cytosines that were mutated to an adenine (A), guanine (G), or thymine (T) are indicated for each base editing construct in the pie chart.

FIG. 113 shows the base editing results for the indicated base editing constructs (BE3, pmCDA1 hAID, hAPOBEC3G, BE4-N, BE4-SSB, BE4-(GGS)$_3$, BE-XTEN, BE4-32aa, and BE4-2xUGI) on the targeted cytokine (C$_5$) of the HEK3 sequence, GGCCC$_5$AGACTGAGCACG-TGATGG (SEQ ID NO: 130). The total percentage of targeted cytosines (Cs) that were mutated are indicated for each base editing construct, under "C$_5$.". The total percentage of indels are indicated for each base editing construct, under "indel". The proportion of mutated cytosines that were mutated to an adenine (A), guanine (G), or thymine (T) are indicated for each base editing construct in the pie chart.

FIG. 114 shows the base editing results for the indicated base editing constructs (BE3, pmCDA1 hAID, hAPOBEC3G, BE4-N, BE4-SSB, BE4-(GGS)$_3$, BE-XTEN, BE4-32aa, and BE4-2xUGI) on the targeted cytokine (C$_5$) of the HEK4 sequence, GGCAC$_5$TGCGGCTGGAG-GTCCGGG (SEQ ID NO: 131). The total percentage of targeted cytosines (Cs) that were mutated are indicated for each base editing construct, under "C$_5$.". The total percentage of indels are indicated for each base editing construct, under "indel". The proportion of mutated cytosines that were mutated to an adenine (A), guanine (G), or thymine (T) are indicated for each base editing construct in the pie chart.

FIG. 115 shows the base editing results for the indicated base editing constructs (BE3, pmCDA1 hAID, hAPOBEC3G, BE4-N, BE4-SSB, BE4-(GGS)$_3$, BE-XTEN, BE4-32aa, and BE4-2×UGI) on the targeted cytokine (C$_6$) of the RNF2 sequence, GTCATC$_6$TTAGTCATTACCTGAGG (SEQ ID NO: 132). The total percentage of targeted cytosines (C$_6$) that were mutated are indicated for each base editing construct, under "C$_5$.". The total percentage of indels are indicated for each base editing construct, under "indel". The proportion of mutated cytosines that were mutated to an adenine (A), guanine (G), or thymine (T) are indicated for each base editing construct in the pie chart.

Figure 116:
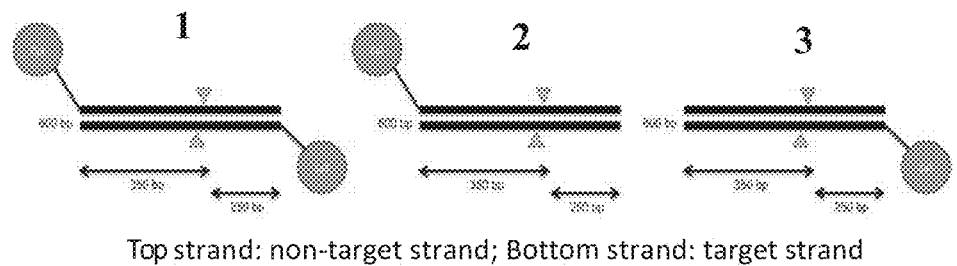

FIG. 116 shows exemplary fluorescent labeled (Cy3 labeled) DNA constructs used to test for Cpf1 mutants that nick the target strand. In the DNA construct of 1, both the non-target strand (top strand) and target strand (bottom strand) are fluorescently labeled. In the DNA construct of 2, the non-target strand (top strand) is fluorescently labeled and the target strand (bottom strand) is not fluorescently labeled. In the DNA construct of 3, the non-target strand (top strand) is not fluorescently labeled and the target strand (bottom strand) is fluorescently labeled.

Figure 117:
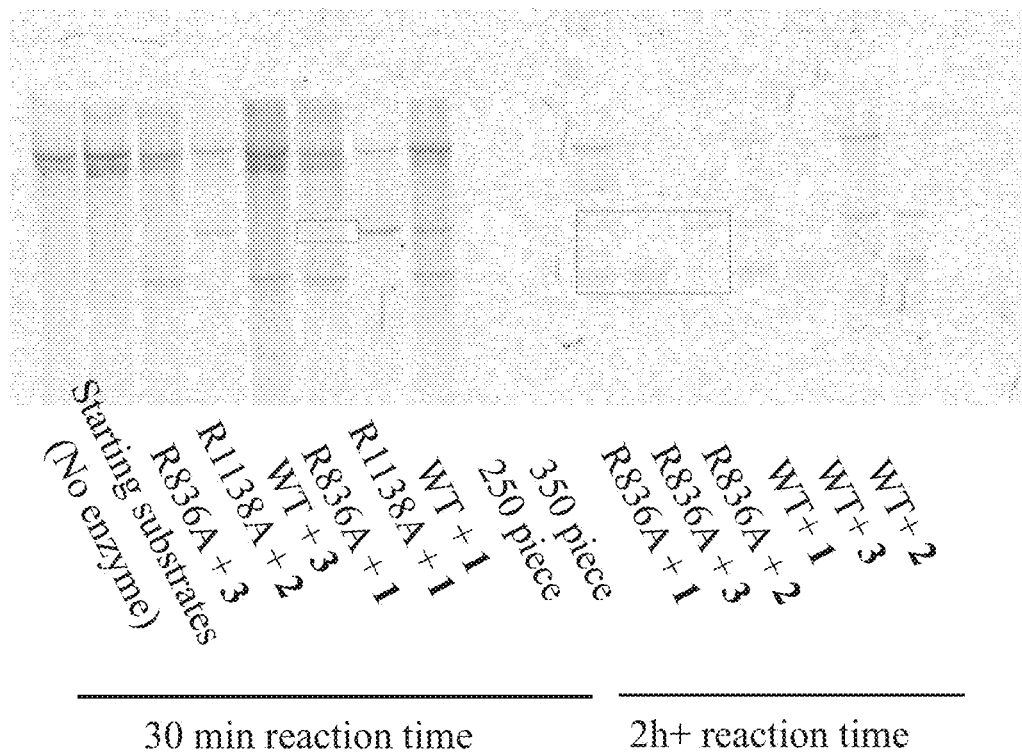

FIG. 117 shows data demonstrating the ability of various Cpf1 constructs (e.g., R836A, R1138A, wild-type) to cleave the target and non-target strands of the DNA constructs shown in FIG. 116 over the reaction time of either 30 minutes (30 min) or greater than two hours (2 h+).

Figure 118:
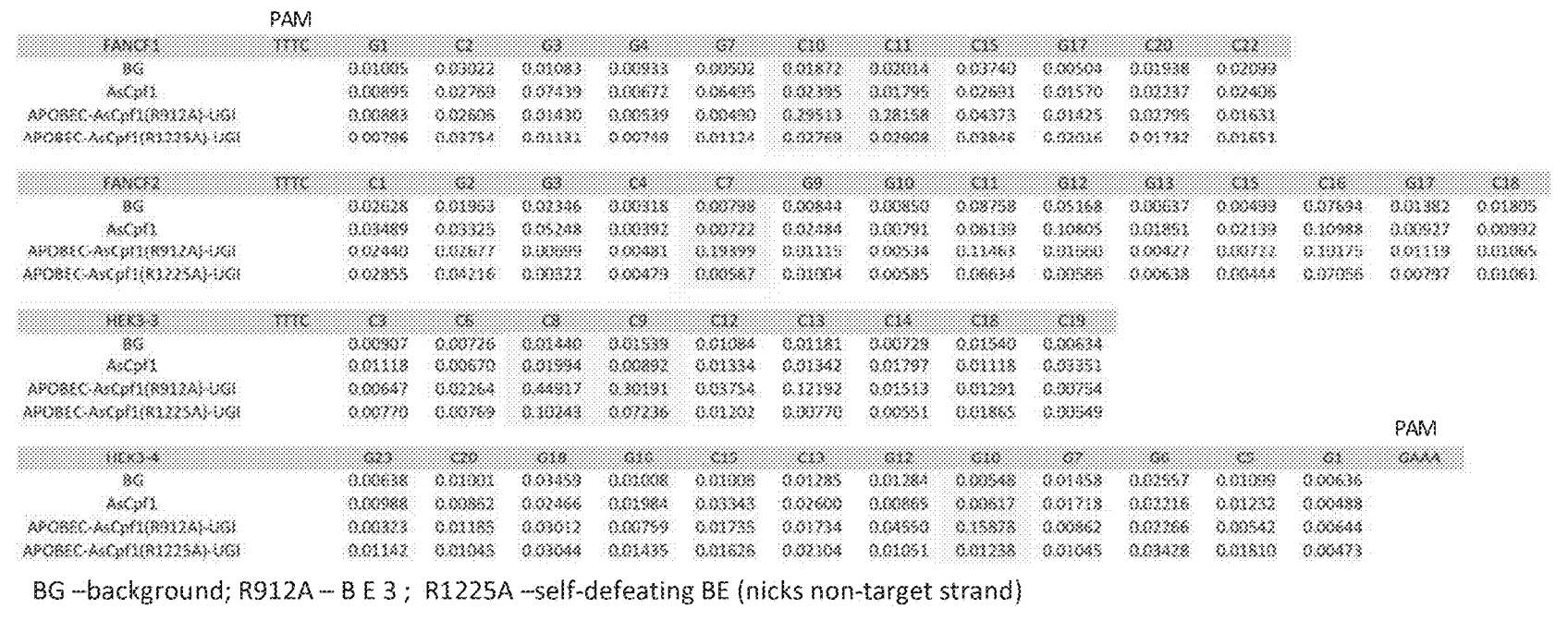

FIG. 118 shows data demonstrating that a base editor having the architecture, APOBEC-AsCpf1(R912A)-UGI is capable of editing C residues (e.g., of target sequences FANCF1, FANCF2, HEK3-3, and HEK3-4) having a window from the 7$^{th}$ to the 11$^{th}$ base of the target sequence. BG indicates background mutation levels (untreated). AsCpf1 indicates AsCpf1 only treated (control), APOBEC-AsCpf1 (R912A)-UGI indicates a base editor containing a Cpf1 that preferentially cuts the target strand, and APOBEC-AsCpf1 (R1225A)-UGI indicates a self-defeating base editor containing a Cpf1 that cuts the non-target strand. The target sequences of FANCF1, FANCF2, HEK3-3, and HEK3-4 are as follows:

```
FANCF1
                              (SEQ ID NO: 724)
GCGGATGTTCCAATCAGTACGCA

FANCF2
                              (SEQ ID NO: 725)
CGAGCTTCTGGCGGTCTCAAGCA

HEK3-3
                              (SEQ ID NO: 726)
TGCTTCTCCAGCCCTGGCCTGG

HEK3-4
                              (SEQ ID NO: 727)
AGACTGAGCACGTGATGGCAGAG
```

Figure 119:

FIG. 119 shows a schematic representation of a base editor comprising a Cpf1 protein (e.g., AsCpf1 or LbCpf1). Different linker sequences (e.g., XTEN, GGS, (GGS)$_3$ (SEQ ID NO: 610), (GGS)$_5$(SEQ ID NO: 610), and (GGS)$_7$ (SEQ ID NO: 610)) were tested for the portion labeled "linker," results of which are shown in FIG. 120.

Figure 120:
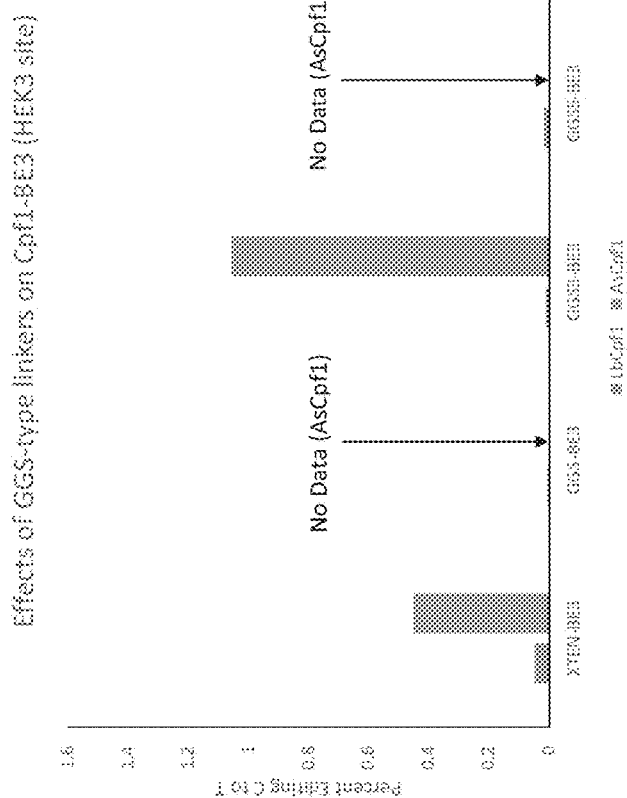

FIG. 120 shows data demonstrating the ability of the construct shown in FIG. 119 to edit the Cs residue of the HEK3 site TGCTTCTC$_8$CAGCCCTGGCCTGG (SEQ ID NO: 592). Different linker sequences, which link the APOBEC domain to the Cpf1 domain (e.g., LbCpf1 (R836A) or AsCpf1(R912A)) were tested. Exemplary linkers that were tested include XTEN, GGS, (GGS)$_3$(SEQ ID NO: 610), (GGS)$_5$(SEQ ID NO: 610), and (GGS)$_7$(SEQ ID NO: 610).

Figure 121:
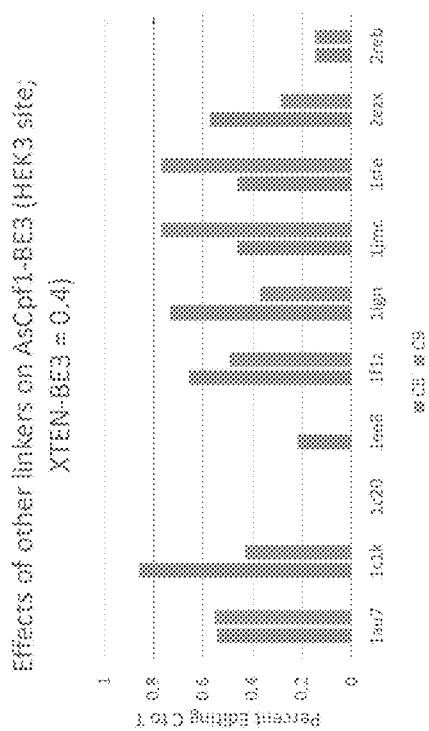

FIG. 121 shows data demonstrating the ability of the construct shown in FIG. 119, having the LbCpf1 domain, to edit the C$_8$ and C$_9$ residues of the HEK3 TGCTTCTC$_8$C$_9$AGCCCTGGCCTGG (SEQ ID NO: 592). Different linker sequences from a database maintained by the Centre of Integrative Bioinformatics VU, which link the APOBEC domain to the LbCpf1 domain were tested. Exemplary linkers that were tested include 1au7, 1c1k, 1c20, 1ee8, 1flz, 1ign, 1jmc, 1sfe, 2ezx, and 2reb.

Figure 122:
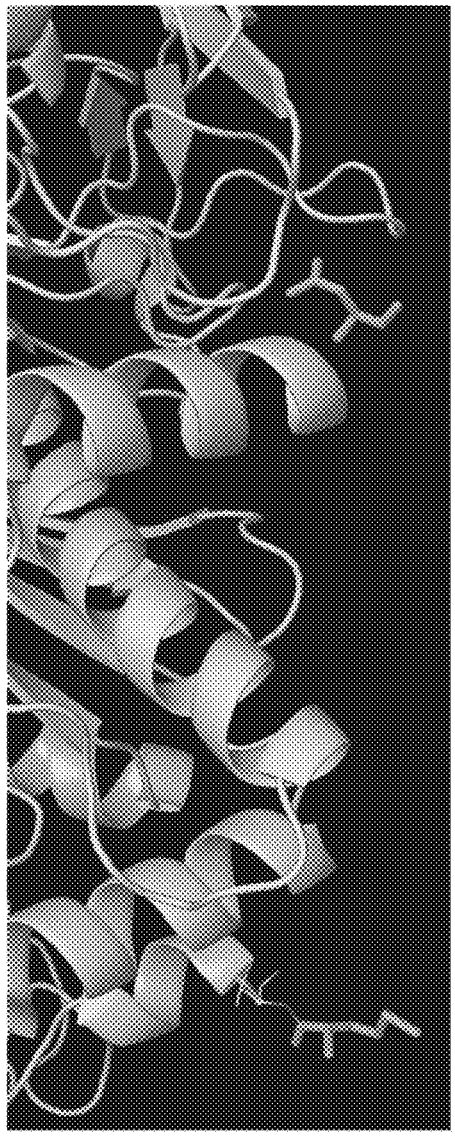

FIG. 122 shows a schematic representation of the structure of AsCpf1, where the N and C termini are indicated.

Figure 123:

FIG. 123 shows a schematic representation of the structure of SpCas9, where the N and C termini are indicated.

Figure 124:
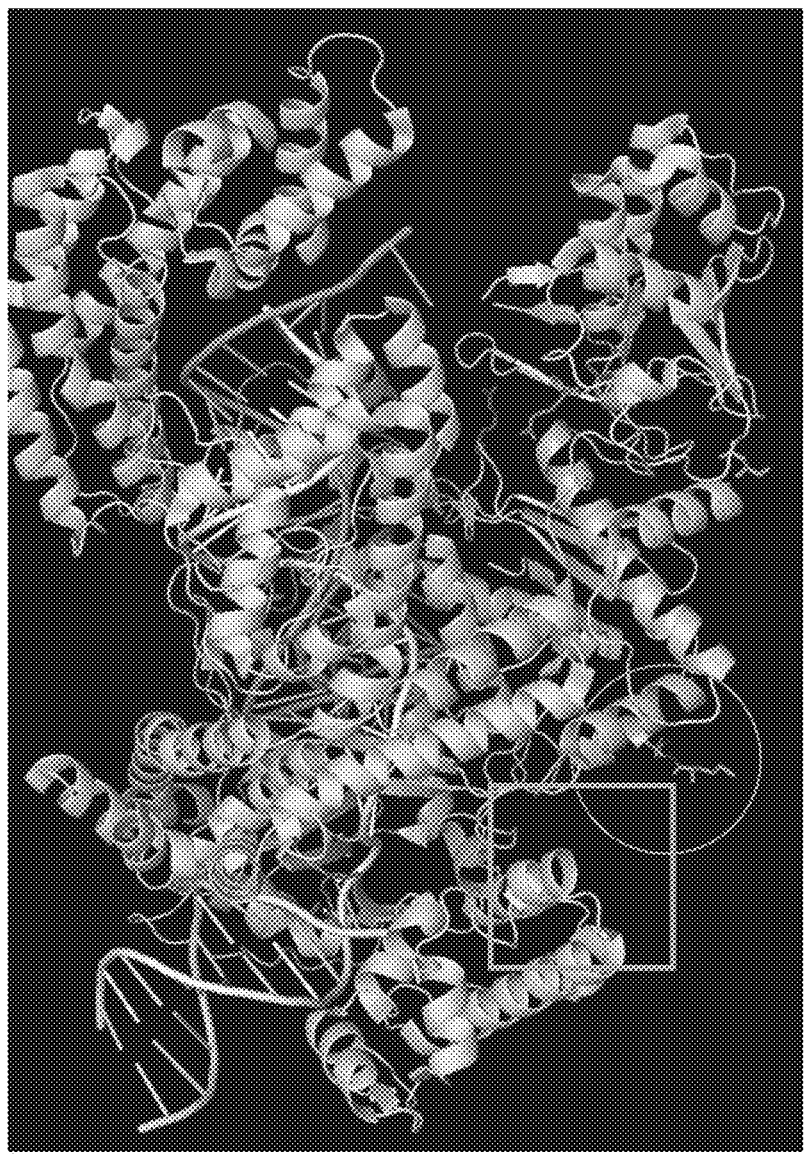

FIG. 124 shows a schematic representation of AsCpf1, where the red circle indicates the predicted area where the editing window is. The square indicates a helical region that may be obstructing APOBEC activity.

Figure 125A:
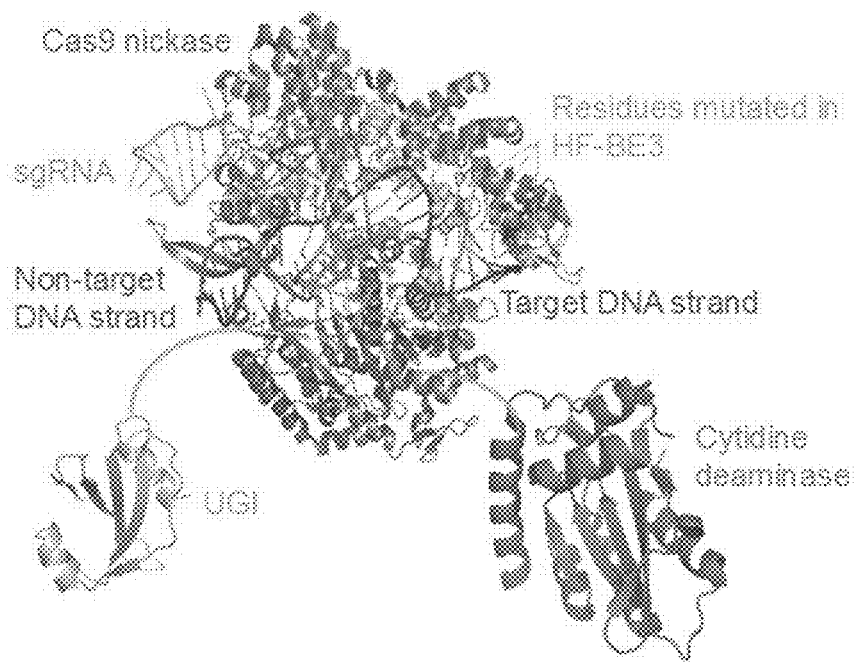
Figure 125B:
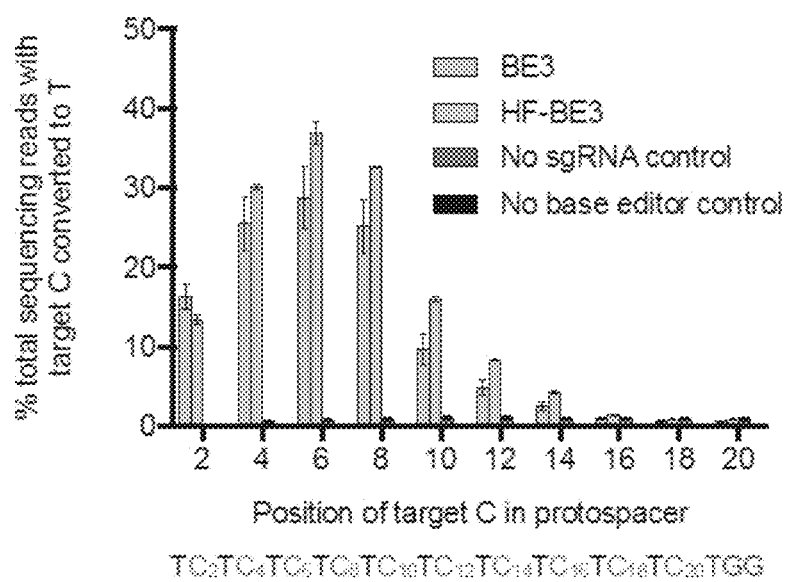

FIGS. 125A and 125B show engineering and in vitro characterization of a high fidelity base editor (HF-BE3). FIG. 125A shows a schematic representation of HF-BE3. Point mutations introduced into BE3 to generate HF-BE3 are shown. The representation used PDB structures 4UN3 (Cas9), 4ROV (cytidine deaminase) and 1UGI (uracil DNA glycosylase inhibitor). FIG. 125B shows in vitro deamination of synthetic substrates containing "TC" repeat protospacers. Values and error bars reflect mean and range of two independent replicates performed on different days.

Figure 126A:
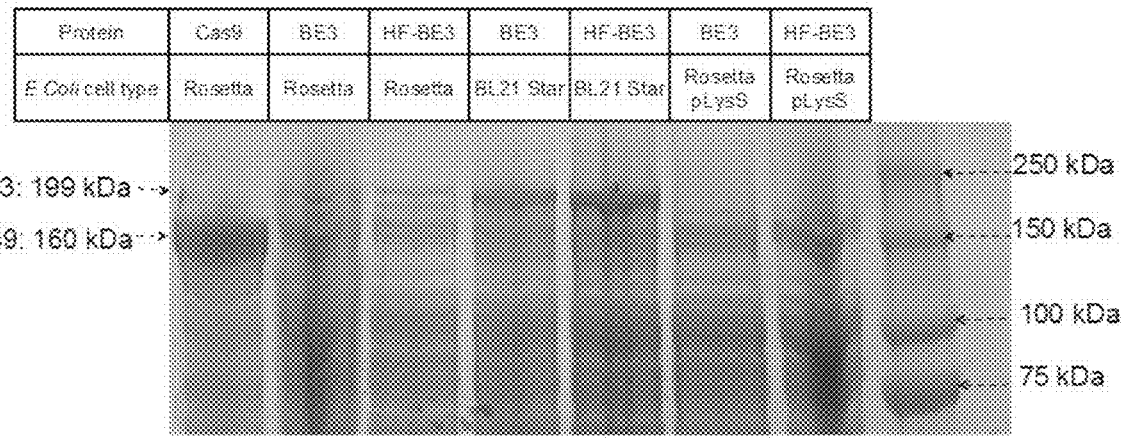
Figure 126B:
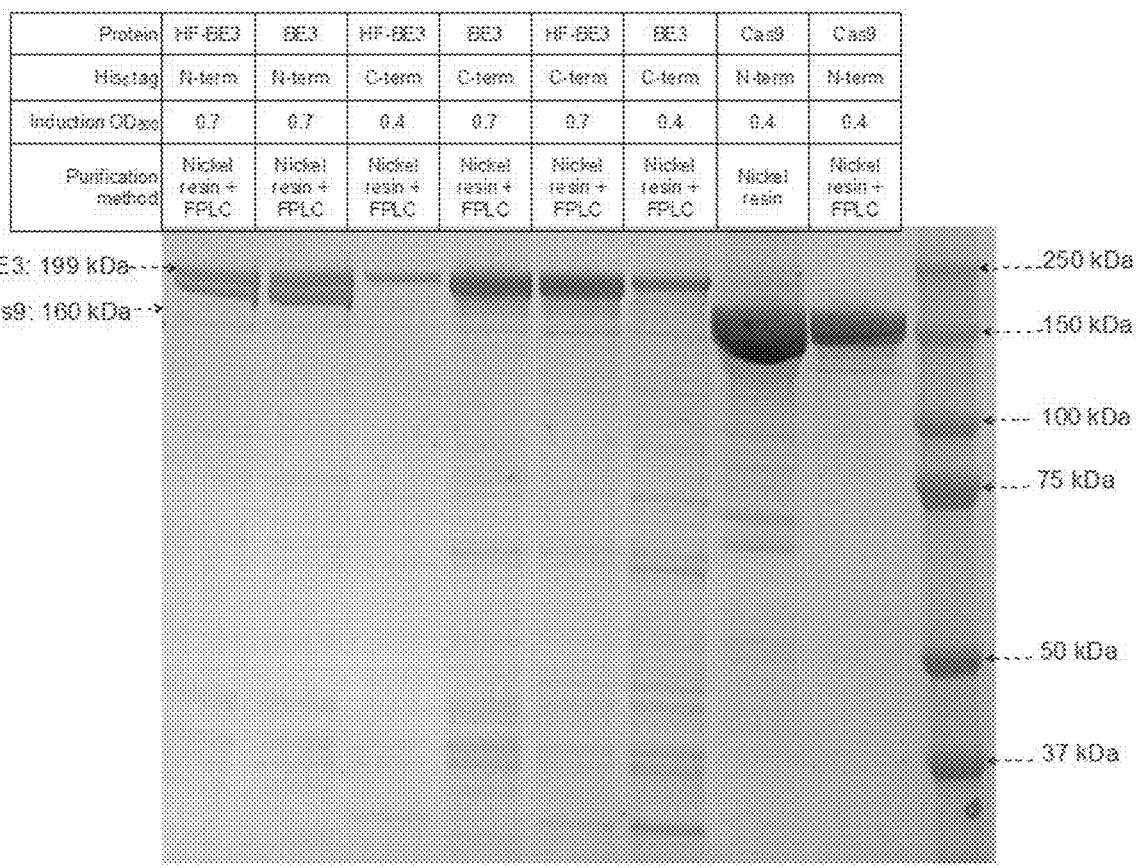
Figure 126C:
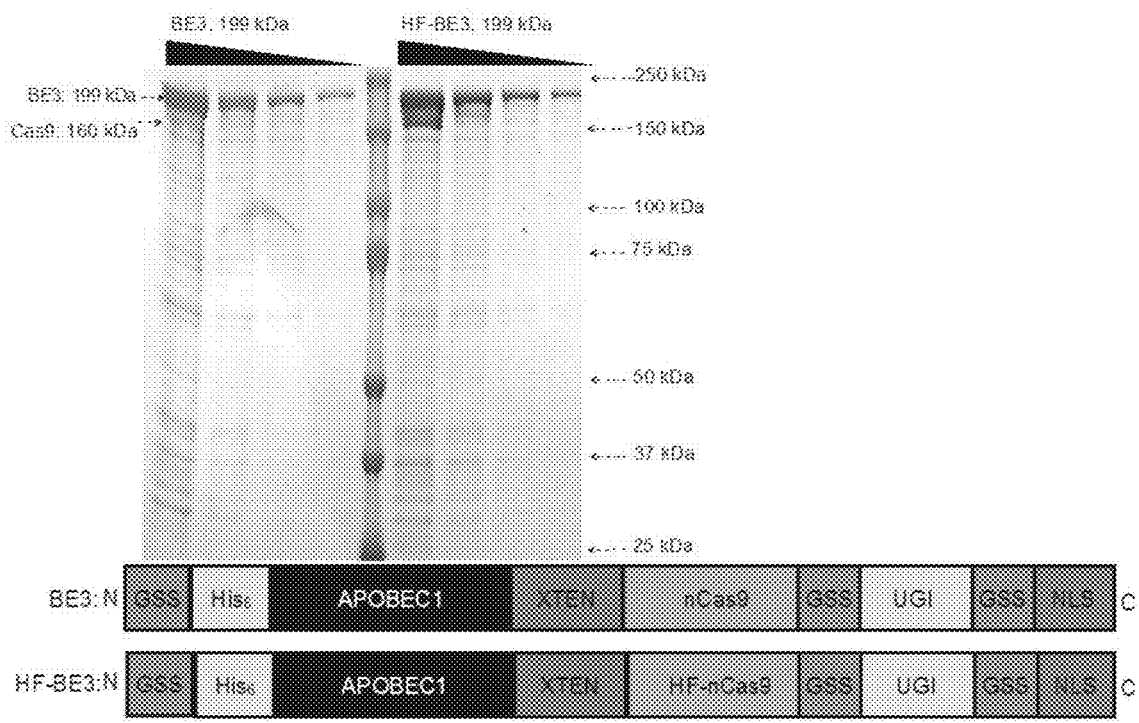

FIGS. 126A to 126C show purification of base editor proteins. FIG. 126A shows selection of optimal E. coli strain for base editor expression. After IPTG-induced protein expression for 16 h at 18° C., crude cell lysate was analyzed for protein content. BL21 Star (DE3) (Thermo Fisher) cells showed the most promising post-expression levels of both BE3 and HF-BE3 and were used for expression of base editors. FIG. 126B shows purification of expressed base editor proteins. Placing the His6 tag on the C-terminus of the base editors lead to production of a truncation product for both BE3 and HF-BE3 (lanes 1 and 2). Unexpectedly, this truncation product was removed by placing the His6 tag on the N-terminus of the protein (lanes 3-6). Inducing expression of base editors at a cell density of OD600=0.7 (lanes 4-5), later than is optimal for Cas9 expression (OD600=0.4) 1, improves yield of base editor proteins. Purification was performed using a manual HisPur resin column followed by cation exchange FPLC (Akta). FIG. 126C shows purified BE3 and HF-BE3. Different concentrations of purified BE3 and HF-BE3 were denatured using heat and LDS and loaded onto a polyacrylamide gel. Protein samples are representative of proteins used in this study. Gels in FIGS. 126A to 126C are BOLT Bis-Tris Plus 4-12% polyacrylamide (Thermo Fisher). Electrophoresis and staining were performed as described in Methods.

Figure 127A:
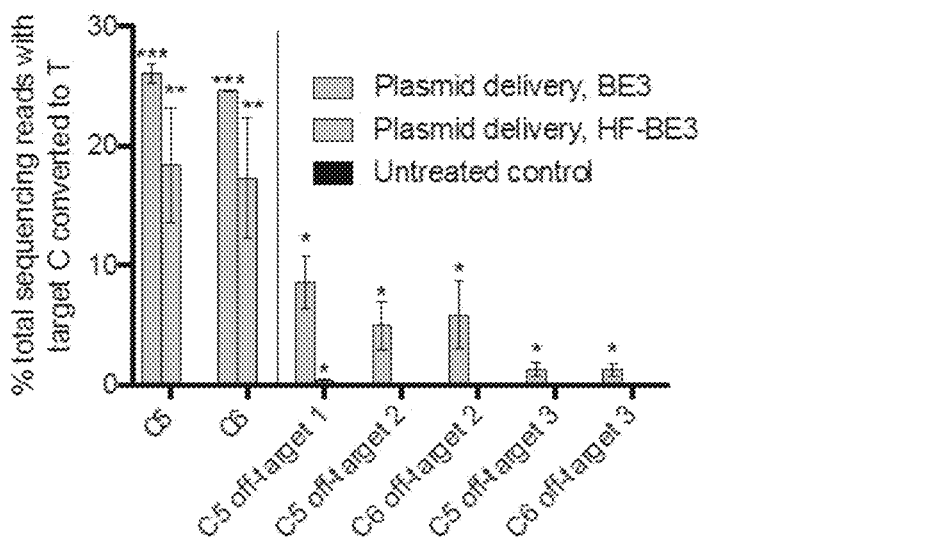
Figure 127B:
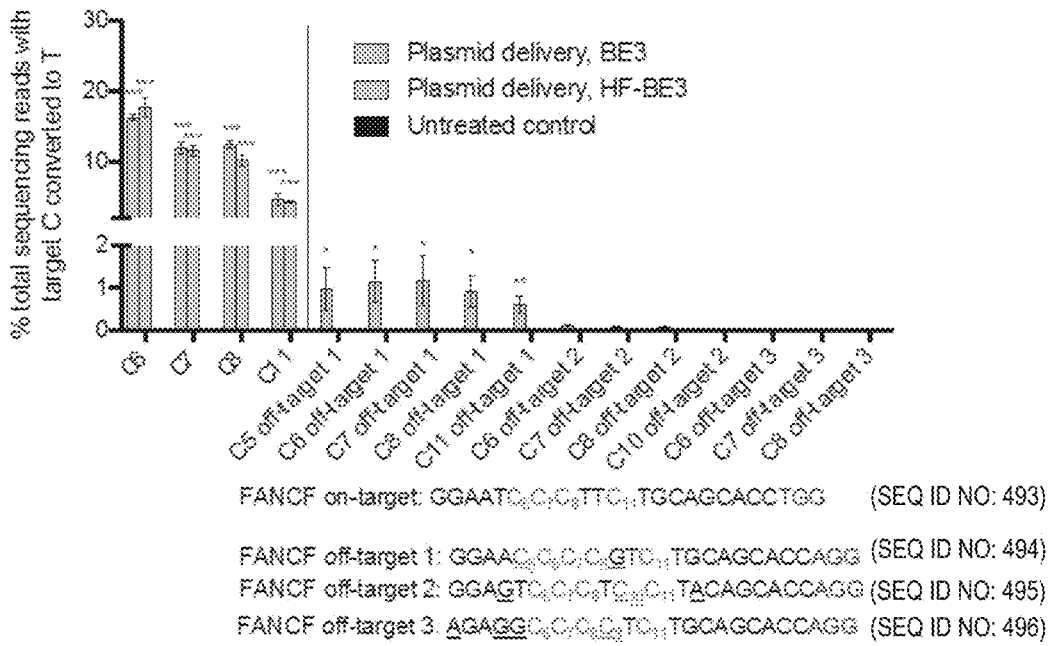
Figure 127C:
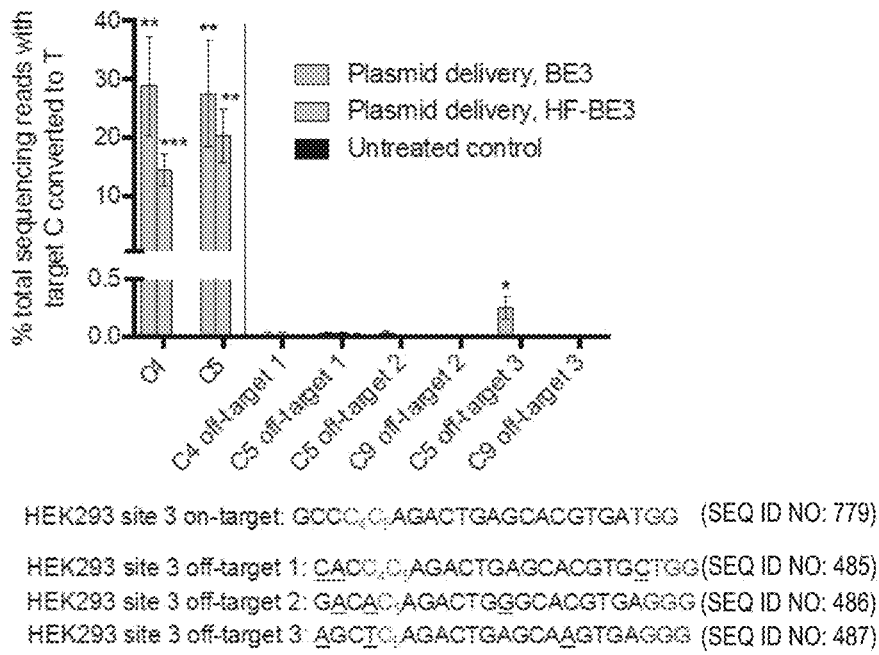
Figure 127D:
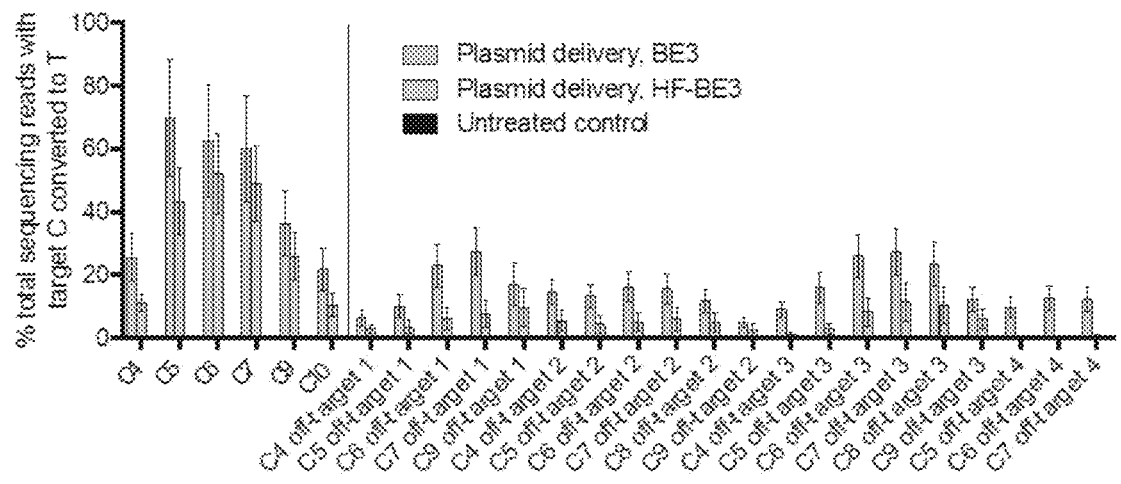

FIGS. 127A to 127D show activity of a high fidelity base editor (HF-BE3) in human cells. FIGS. 127A to 127C show on- and off-target editing associated with plasmid transfection of BE3 and HF-BE3 was assayed using high-throughput sequencing of genomic DNA from HEK293T cells treated with sgRNAs targeting non-repetitive genomic loci EMX1 (FIG. 127A), FANCF (FIG. 127B), and HEK293 site 3 (FIG. 127C). On- and off-target loci associated with each sgRNA are separated by a vertical line. FIG. 127D shows on- and off-target editing associated with the highly repetitive sgRNA targeting VEGFA site 2. Values and error bars reflect mean±S.D. of three independent biological replicates performed on different days. For FIGS. 127A to 127C, stars indicate significant editing based on a comparison between the treated sample and an untreated control. * p≤0.05,  p≤0.01 and * p≤0.001 (Student's two tailed t-test). For FIG. 127D, asterisks are not shown since all treated samples displayed significant editing relative to the control. Individual p-values are listed in in Table 16.

Figure 128A:
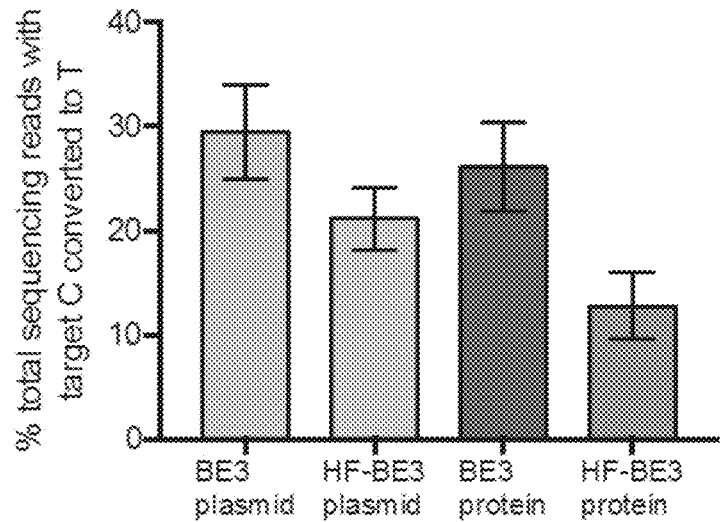
Figure 128B:
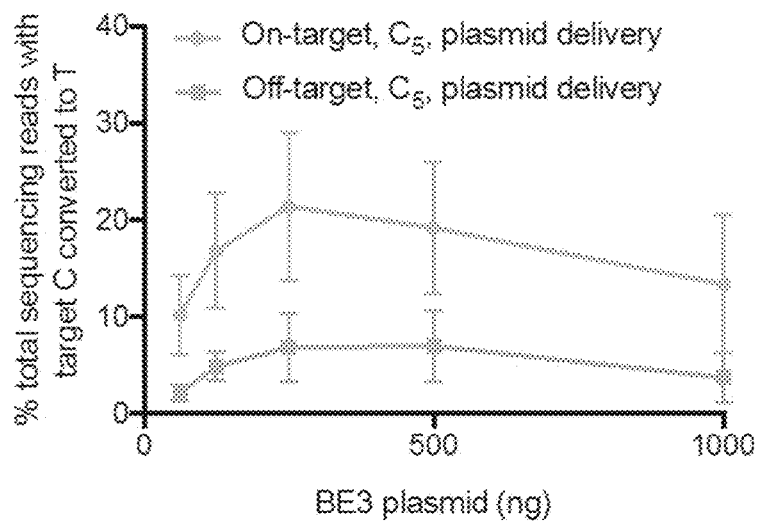
Figure 128C:
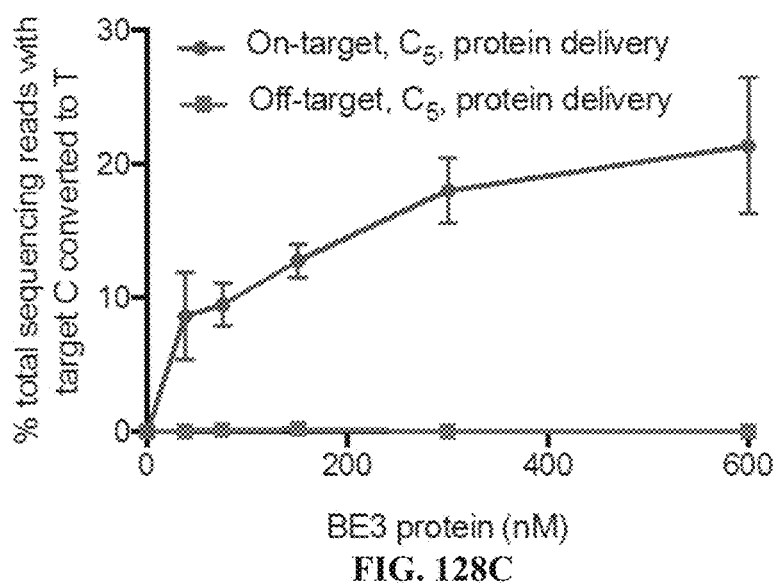

FIGS. 128A to 128C show the effect of dosage of BE3 protein or plasmid on the efficiency of on-target and off-target base editing in cultured human cells. FIG. 128A shows on-target editing efficiency at each of the four genomic loci was averaged across all edited cytosines in the activity window for each sgRNA. Values and error bars reflect mean±S.E.M of three independent biological replicates performed on different days. FIGS. 128B and 128C show on- and off-target editing at the EMX1 site arising from BE3 plasmid titration (FIG. 128B) or BE3 protein titration (FIG. 128C) in HEK293T cells. Values and error bars reflect mean±S.D. of three independent biological replicates performed on different days.

Figure 129A:
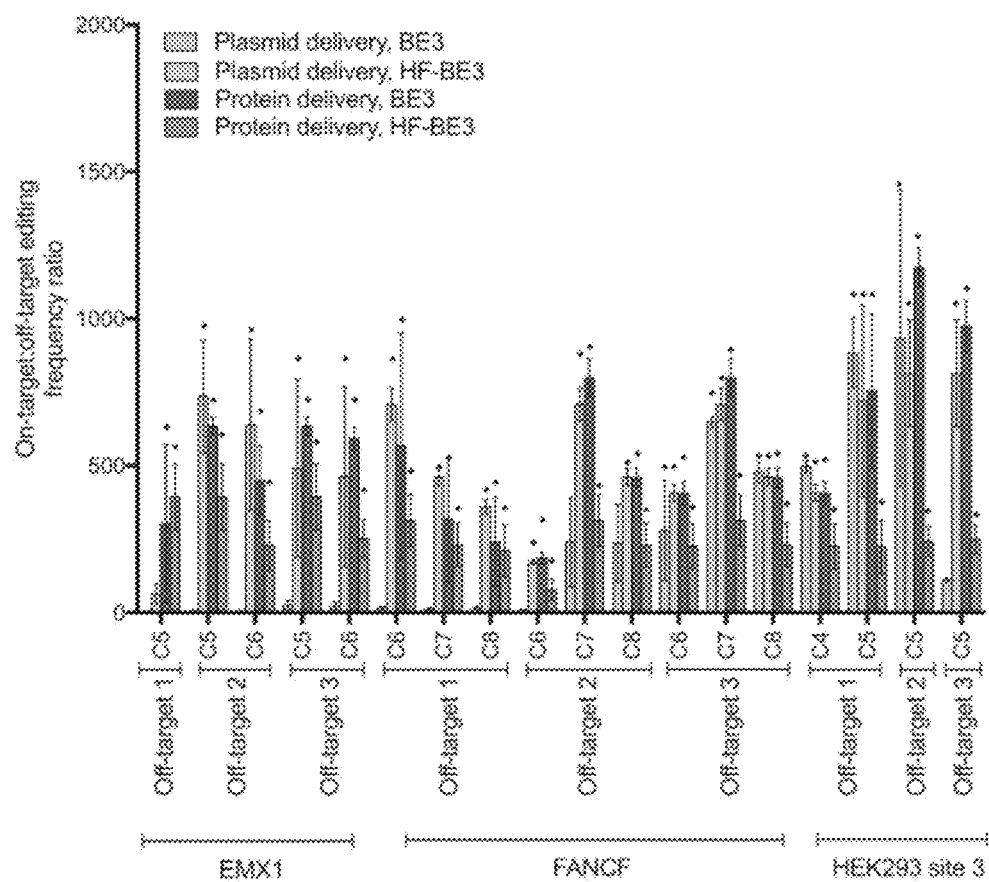
Figure 129B:
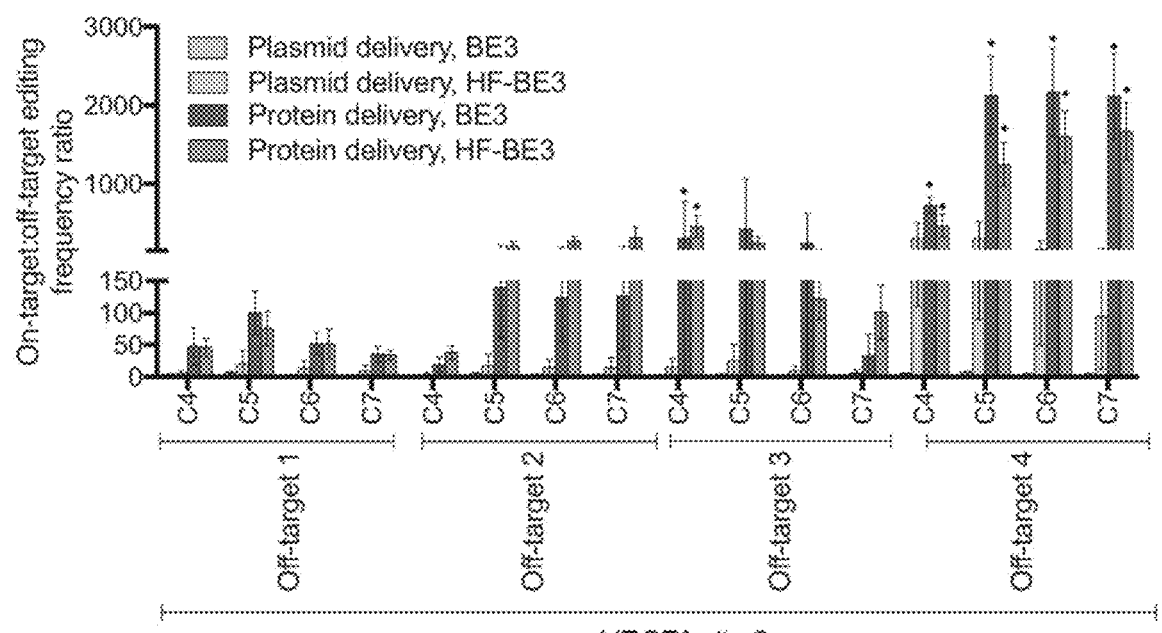

FIGS. 129A to 129B show on-target:off-target base editing frequency ratios for plasmid and protein delivery of BE3 and HF-BE3. Base editing on-target:off-target specificity ratios were calculated by dividing the on-target editing percentage at a particular cytosine in the activity window by the off-target editing percentage at the corresponding cytosine for the indicated off-target locus (see Methods). When off-target editing was below the threshold of detection (0.025% of sequencing reads), we set the off-target editing to the limit of detection (0.025%) and divided the on-target editing percentage by this upper limit. In these cases, denoted by ♦, the specificity ratios shown represent lower limits. Specificity ratios are shown for non-repetitive sgRNAs FANCF, HEK 293 site 3, and FANCF (FIG. 129A) and for the highly repetitive sgRNA VEGFA site 2 (FIG. 129B). Values and error bars reflect mean±S.D. of three independent biological replicates performed on different days.

FIGS. 130A to 130D show protein delivery of base editors into cultured human cells. FIGS. 130A to 130D show on- and off-target editing associated with RNP delivery of base editors complexed with sgRNAs targeting EMX1 (FIG. 130A), FANCF (FIG. 130B), HEK293 site 3 (FIG. 130C) and VEGFA site 2 (FIG. 130D). Off-target base editing was undetectable at all of the sequenced loci for non-repetitive sgRNAs. Values and error bars reflect mean±S.D. of three independent biological replicates performed on different days. Stars indicate significant editing based on a comparison between the treated sample and an untreated control. * p≤0.05,  p≤0.01 and * p≤0.001 (Student's two tailed t-test).

Figure 131A:
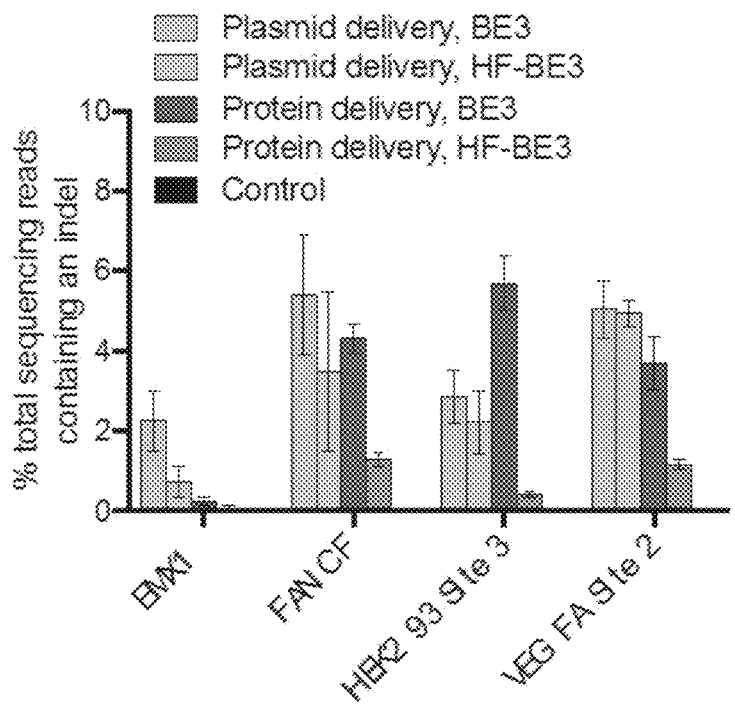
Figure 131B:
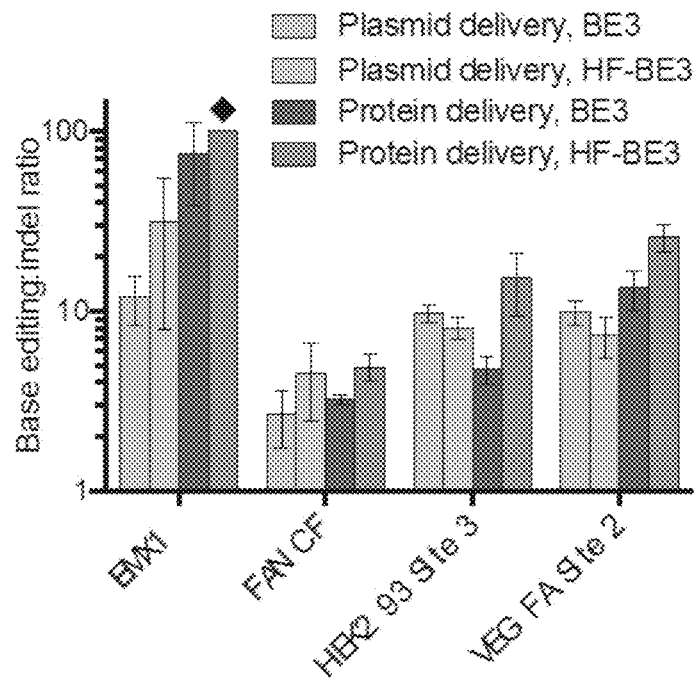
Figure 131C:
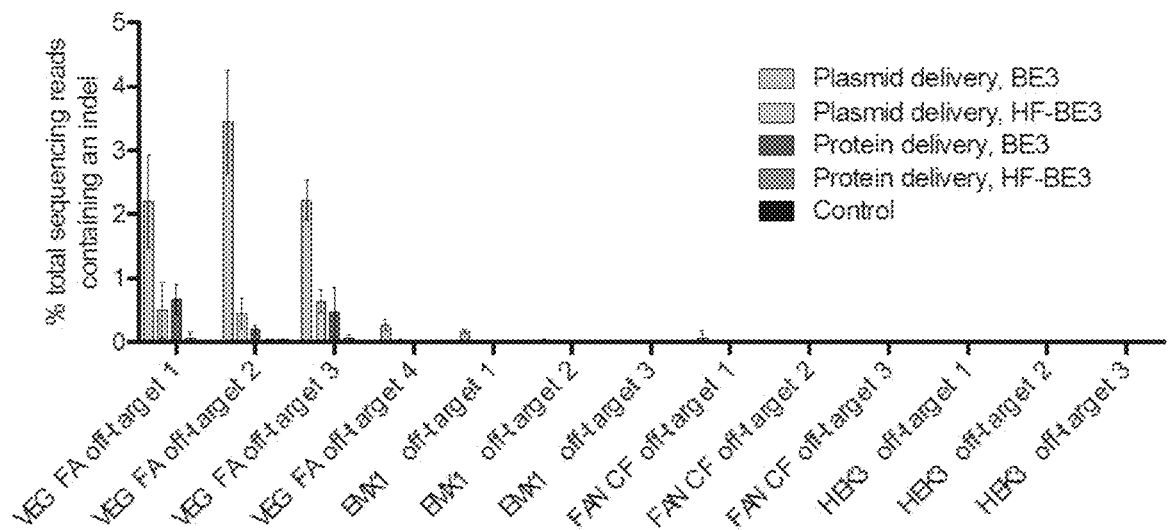

FIGS. 131A to 131C show indel formation associated with base editing at genomic loci. FIG. 131A shows indel frequency at on-target loci for VEGFA site 2, EMX1, FANCF, and HEK293 site 3 sgRNAs. FIG. 131B shows the ratio of base editing:indel formation. The diamond (♦) indicates no indels were detected (no significant difference in indel frequency in the treated sample and in the untreated control). FIG. 131C shows indels observed at the off-target loci associated with the on-target sites interrogated in FIG. 131A. Values and error bars reflect mean±S.D. of three independent biological replicates performed on different days.

Figure 132A:
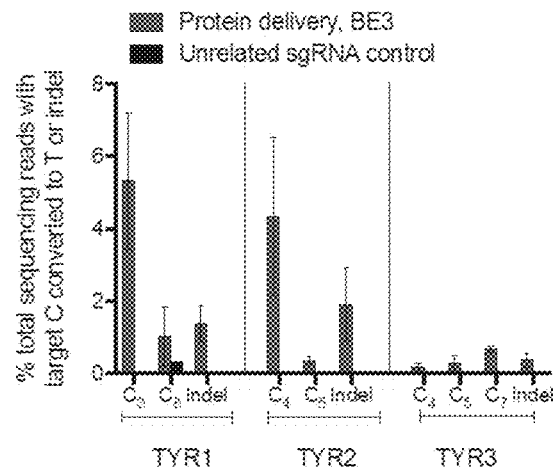
Figure 132B:
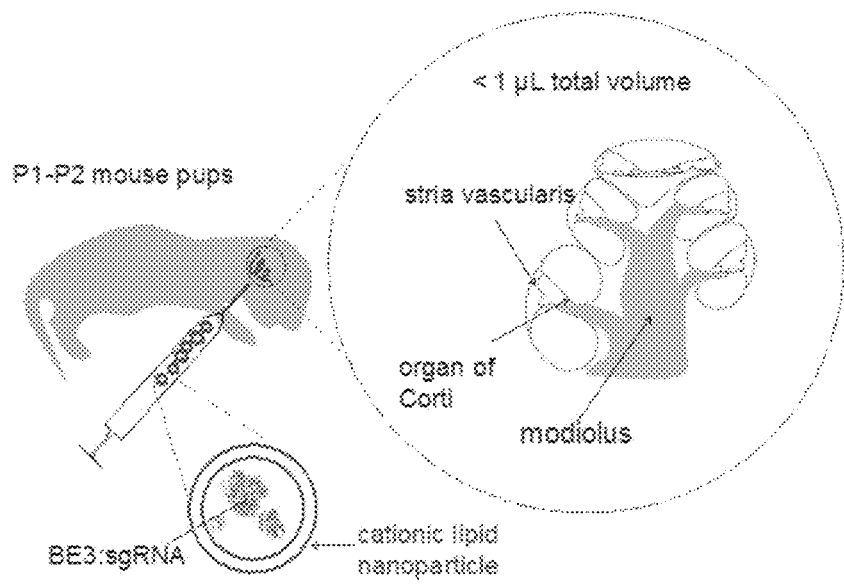
Figure 132C:
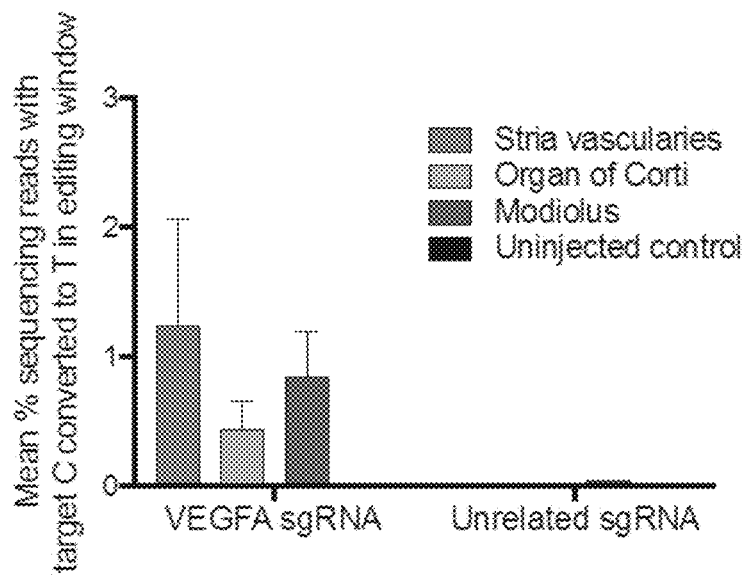

FIGS. 132A to 132D show DNA-free in vivo base editing in zebrafish embryos and in the inner ear of live mice using RNP delivery of BE3. FIG. 132A shows on-target genome editing in zebrafish harvested 4 days after injection of BE3 complexed with indicated sgRNA. Values and error bars reflect mean±s.d. of three injected and three control zebrafish. Controls were injected with BE3 complexed with an unrelated sgRNA. FIG. 132B shows schematic showing in vivo injection of BE3:sgRNA complexes encapsulated into cationic lipid nanoparticles FIG. 132C shows base editing of cytosine residues in the base editor window at the VEGFA site 2 genomic locus. FIG. 132D shows on-target editing at each cytosine in the base editing window of the VEGFA site 2 target locus. FIG. 132D (FIGS. 132C and 132D) shows values and error bars reflect mean±S.E.M. of three mice injected with sgRNA targeting VEGFA Site 2, three uninjected mice and one mouse injected with unrelated sgRNA.

Figure 133A:
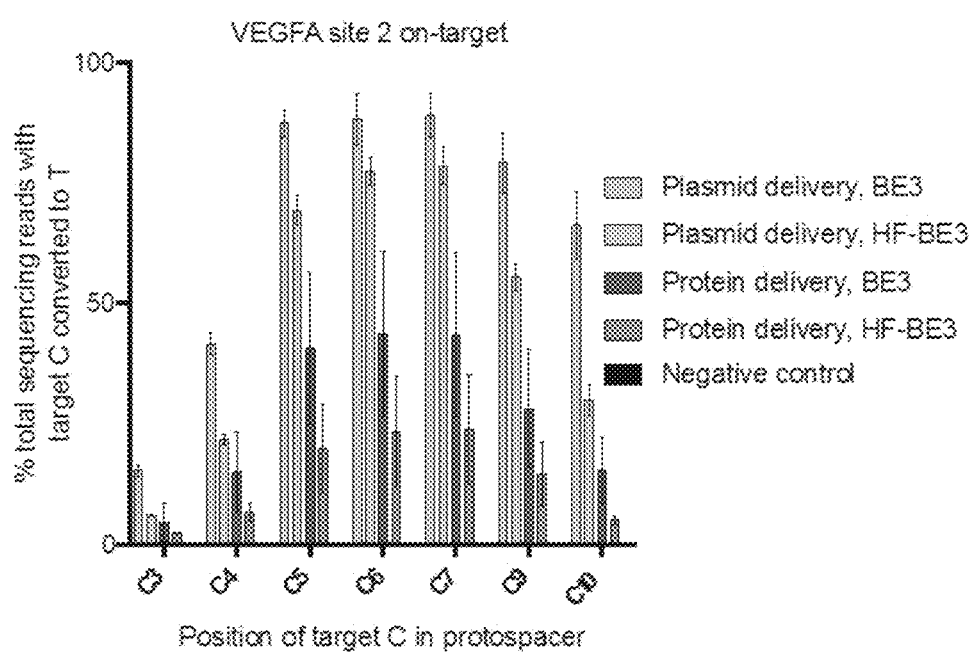
Figure 133B:
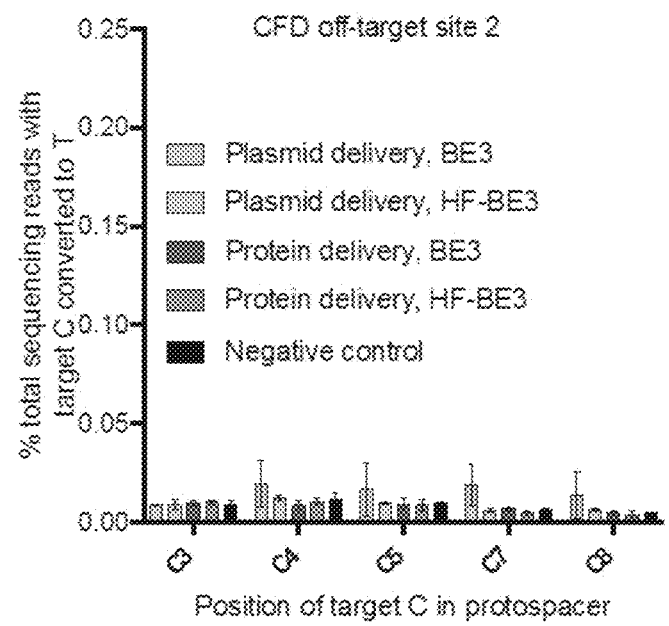
Figure 133C:
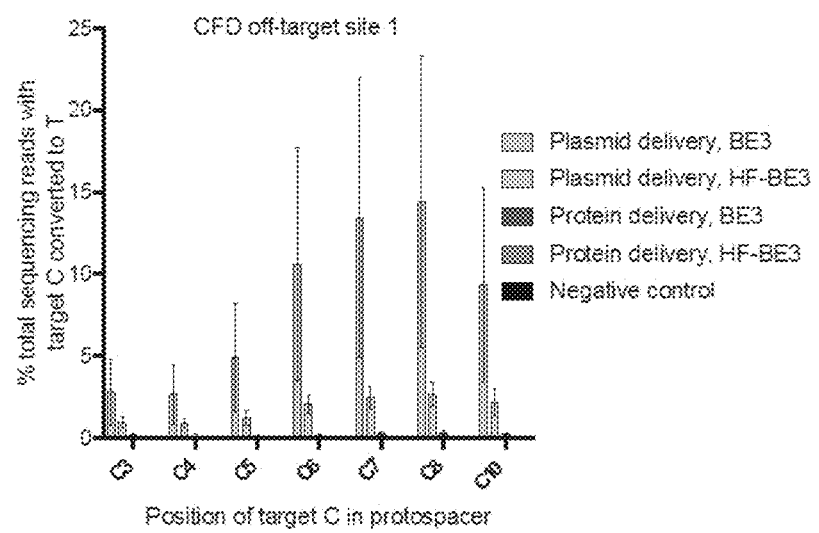
Figure 133D:
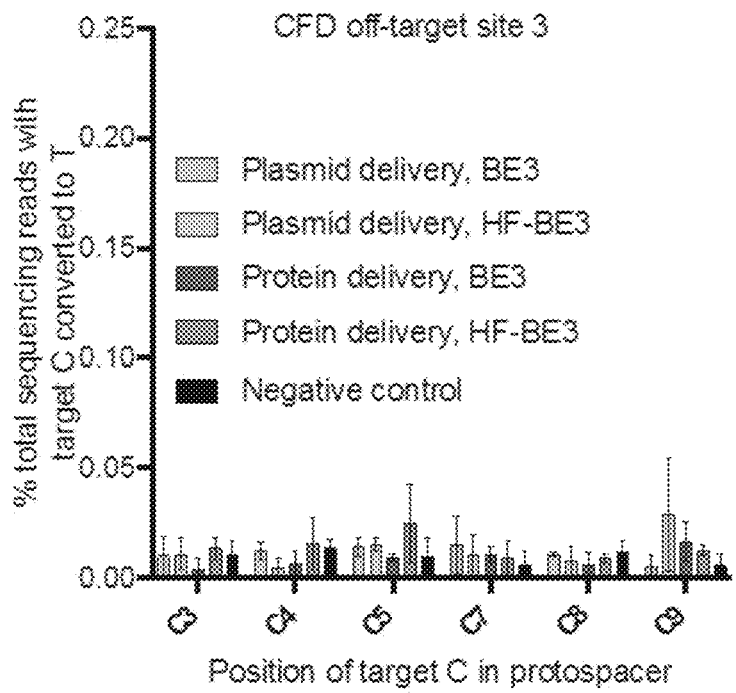
Figure 133E:
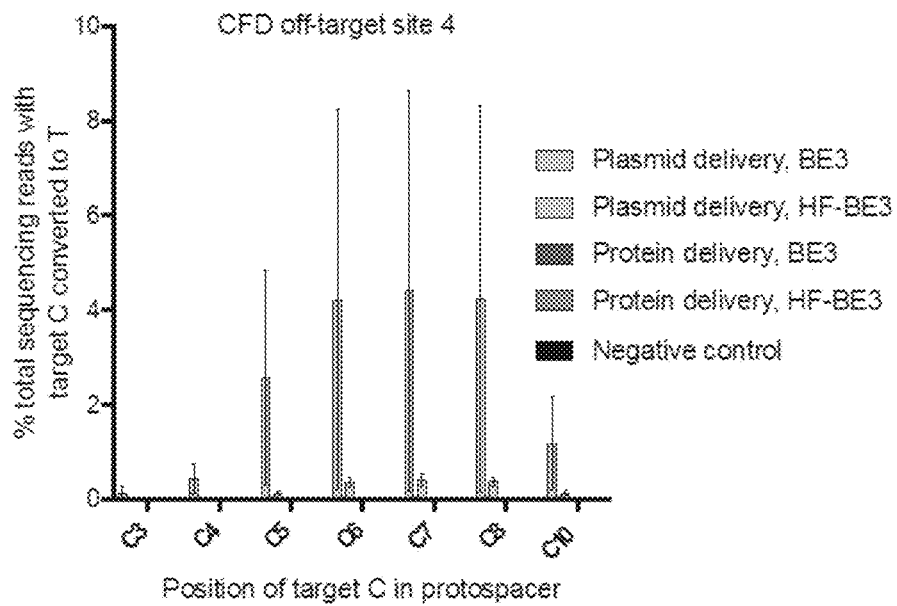

FIGS. 133A to 133E show on- and off-target base editing in murine NIH/3T3 cells. FIG. 133A shows on-target base editing associated with the 'VEGFA site 2' sgRNA (See FIG. 132E for sequences). The negative control corresponds to cells treated with plasmid encoding BE3 but no sgRNA. Values and error bars reflect mean±S.D. of three independent biological replicates performed on different days. FIGS. 133B to 133E show off-target editing associated with this site was measured using high-throughput DNA sequencing at the top four predicted off-target loci for this sgRNA (sequences shown in FIG. 132E). FIG. 133B shows off-target 2, FIG. 133C shows off-target 1, FIG. 133D shows off-target 3, FIG. 133E shows off-target 4. Values and error bars reflect mean±S.D. of three independent biological replicates performed on different days.

Figure 134A:
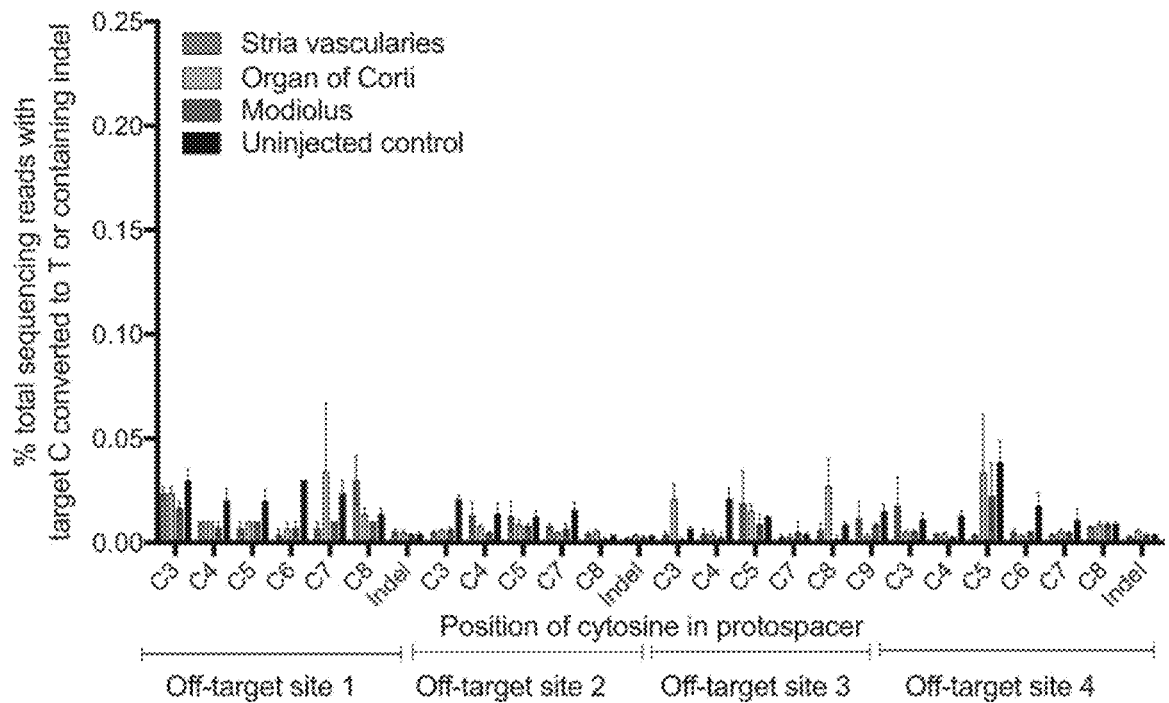
Figure 134B:
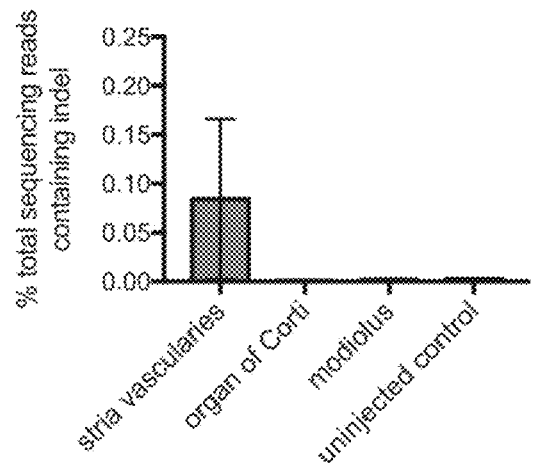

FIGS. 134A to 134B show off-target base editing and on-target indel analysis from in vivo-edited murine tissue. FIG. 134A shows editing plotted for each cytosine in the base editing window of off-target loci associated with VEGFA site 2. FIG. 134B shows indel rates at the on-target base editor locus. Values and error bars reflect mean±S.E.M of three injected and three control mice.

FIGS. 135A to 135C show the effects on base editing product purity of knocking out UNG. FIG. 135A shows HAP1 (UNG⁺) and HAP1 UNG⁻ cells treated with BE3 as described in the Materials and Methods of Example 17. The product distribution among edited DNA sequencing reads (reads in which the target C is mutated) is shown. FIG. 135B shows protospacers and PAM sequences of the genomic loci tested, with the target Cs analyzed in FIG. 135A shown in red. FIG. 135C shows the frequency of indel formation following treatment with BE3 in HAP1 cells or HAP1 UNG⁻ cells. Values and error bars reflect the mean±S.D. of three independent biological replicates performed on different days.

Figure 136A:
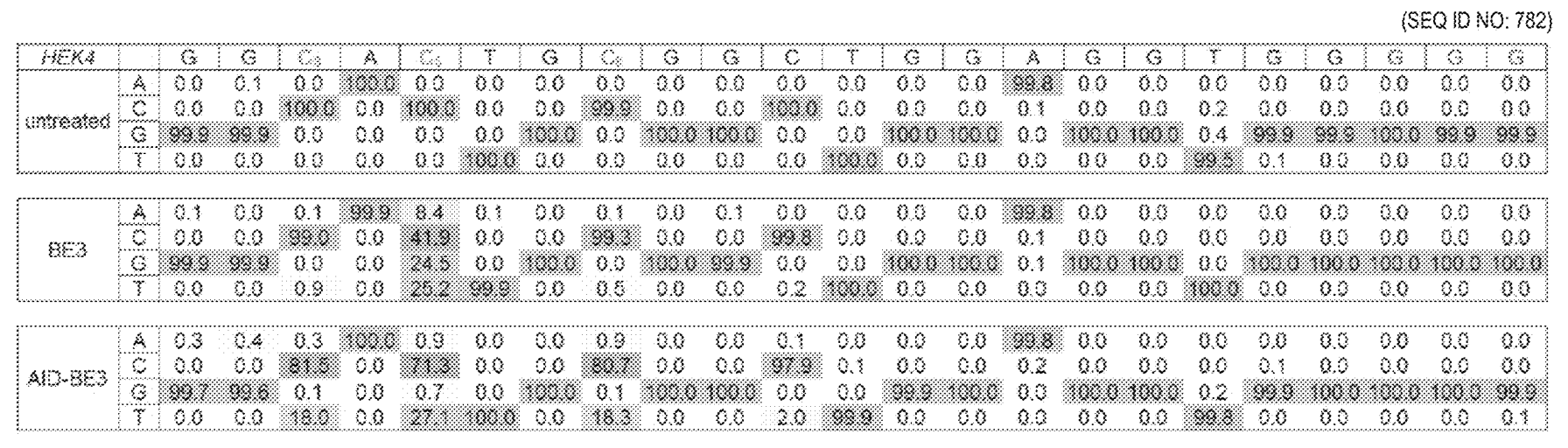

FIGS. 136A to 136D show the effects of multi-C base editing on product purity. FIG. 136A shows representative high-throughput sequencing data of untreated, BE3-treated, and AID-BE3-treated human HEK293T cells. The sequence of the protospacer is shown at the top, with the PAM and the target Cs in red with subscripted numbers indicating their position within the protospacer. Underneath each sequence are the percentages of total sequencing reads with the corresponding base. The relative percentage of target Cs that are cleanly edited to T rather than to non-T bases is much higher for AID-BE3-treated cells, which edits three Cs at this locus, than for BE3-treated cells, which edits only one C. FIG. 136B shows HEK293T cells treated with BE3, CDA1-BE3, and AID-BE3 as described in the Materials and Methods of Example 17. The product distribution among edited DNA sequencing reads (reads in which the target C is mutated) is shown. FIG. 136C shows protospacers and PAM sequences of genomic loci studied, with the target Cs that are analyzed in FIG. 136B shown in red. FIG. 136D shows the frequency of indel formation following the treatment shown in FIG. 136A. Values and error bars reflect the mean±S.D. of three independent biological replicates performed on different days.

Figures 137A, 137B:
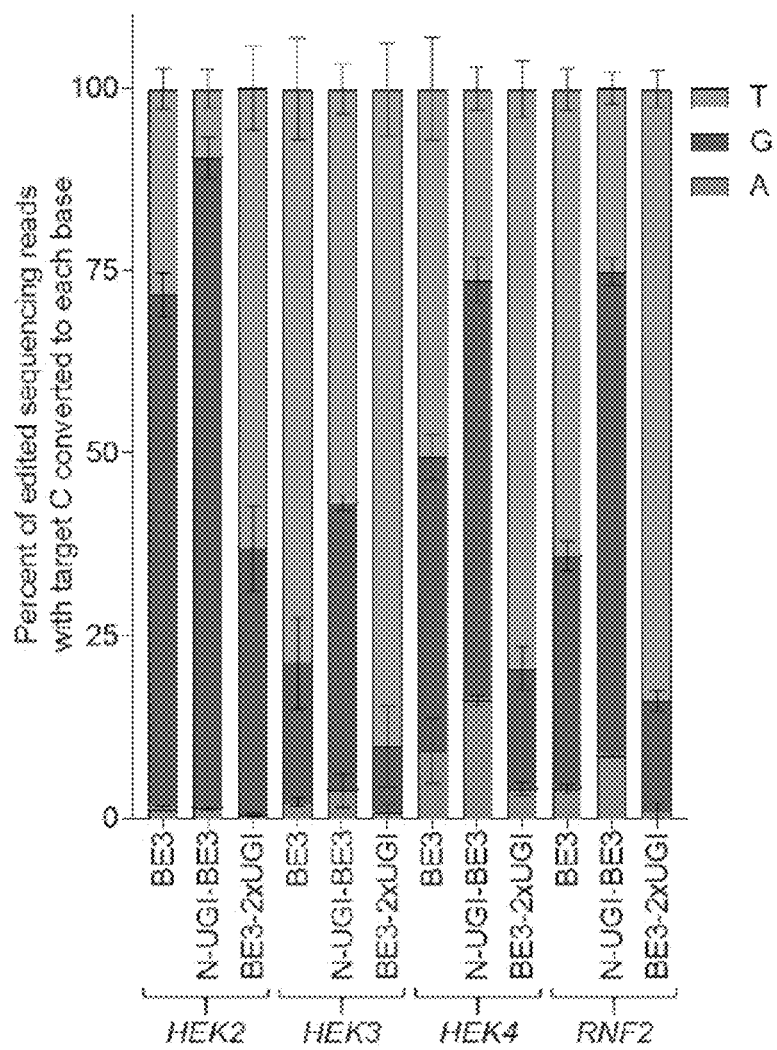
Figure 137C:
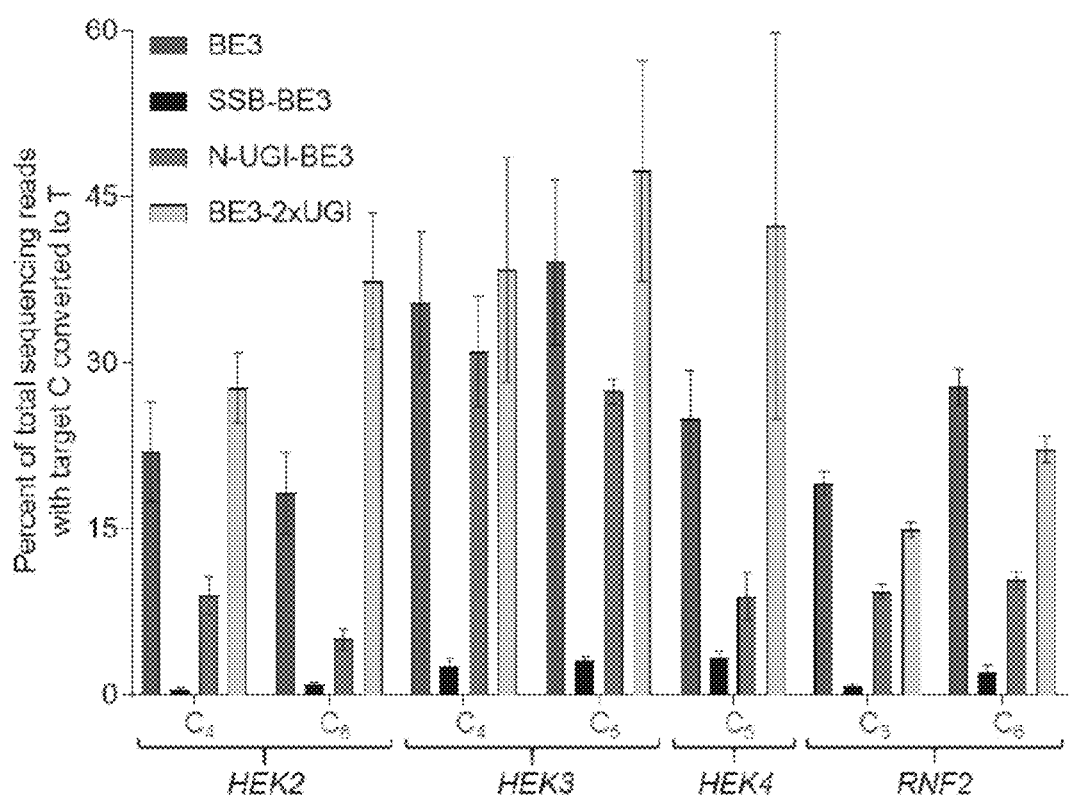

FIGS. 137A to 137C show the effects on C-to-T editing efficiencies and product purities of changing the architecture of BE3. FIG. 137A shows protospacers and PAM sequences of genomic loci studied, with the target Cs in FIG. 137C shown in purple and red, and the target Cs in FIG. 137B shown in red. FIG. 137B shows HEK293T cells treated with BE3, SSB-BE3, N-UGI-BE3, and BE3-2×UGI as described in the Materials and Methods of Example 17. The product distribution among edited DNA sequencing reads (reads in which the target C is mutated) is shown for BE3, N-UGI-BE3, and BE3-2×UGI. FIG. 137C shows C-to-T base editing efficiencies. Values and error bars reflect the mean±S.D. of three independent biological replicates performed on different days.

Figure 138D:
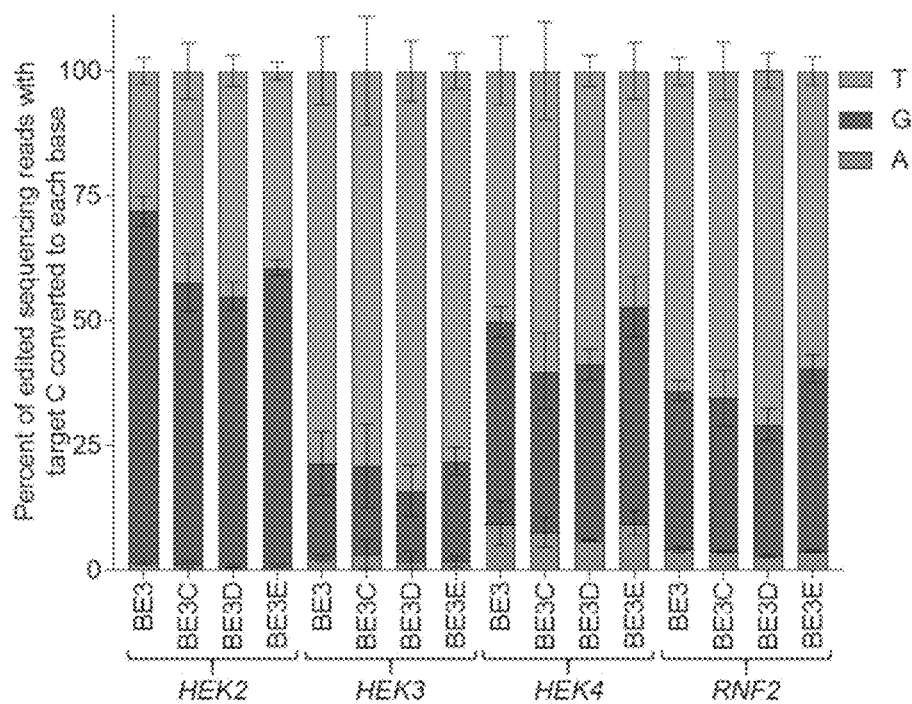

FIGS. 138A to 138D show the effects of linker length variation in BE3 on C-to-T editing efficiencies and product purities. FIG. 138A shows the architecture of BE3, BE3C, BE3D, and BE3E FIG. 138B shows protospacers and PAM sequences of genomic loci studied, with the target Cs in FIG. 138C shown in purple and red, and target Cs in FIG. 138D shown in red. FIG. 138C shows HEK293T cells treated with BE3, BE3C, BE3D, or BE3E as described in the Materials and Methods of Example 17. C-to-T base editing efficiencies are shown. FIG. 138D shows the product distribution among edited DNA sequencing reads (reads in which the target C is mutated) for BE3, BE3C, BE3D, and BE3E. Values and error bars reflect the mean±S.D. of three independent biological replicates performed on different days.

Figure 139D:
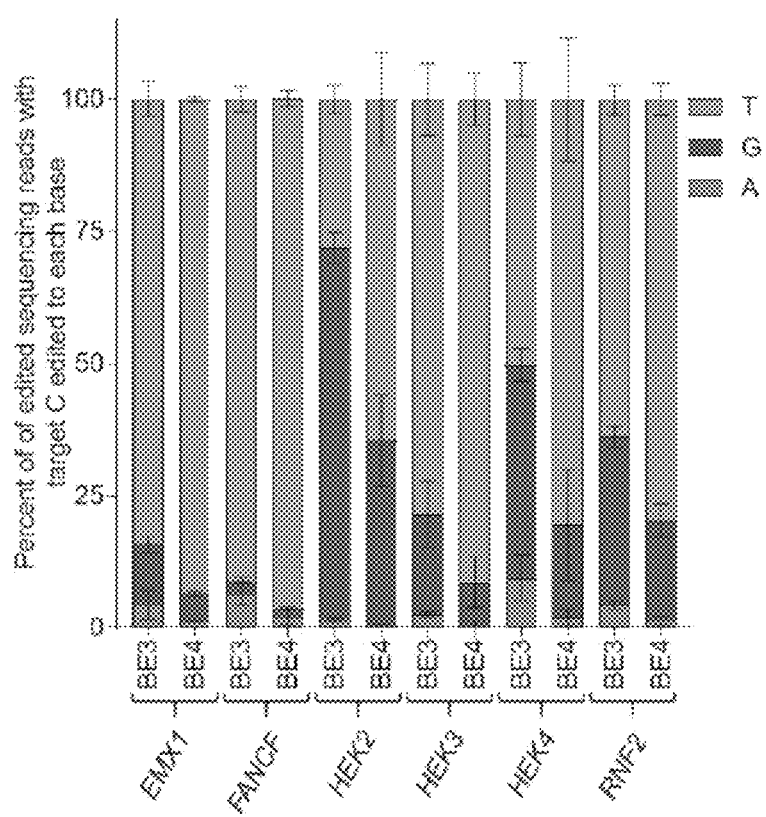

FIGS. 139A to 139D show BE4 increases base editing efficiency and product purities compared to BE3. FIG. 139A shows the architectures of BE3, BE4, and Target-AID. FIG. 139B shows protospacers and PAM sequences of genomic loci studied, with the target Cs in FIG. 139C shown in purple and red, and the target Cs in FIG. 139D shown in red. FIG. 139C shows HEK293T cells treated with BE3, BE4, or Target-AID as described in the Materials and Methods of Example 17. C-to-T base editing efficiencies are shown. FIG. 139D shows the product distribution among edited DNA sequencing reads (reads in which the target C is mutated) for BE3 and BE4. Values and error bars reflect the mean±S.D. of three independent biological replicates performed on different days.

FIGS. 140A to 140C show CDA1-BE3 and AID-BE3 edit Cs following target Gs more efficiently than BE3. FIG. 140A shows protospacer and PAM sequences of genomic loci studied, with target Cs edited by BE3, CDA1-BE3, and AID-BE3 shown in red, and target Cs (following Gs) edited by CDA1-BE3 and AID-BE3 only shown in purple. FIG. 140B shows HEK293T cells treated with BE3, CDA1-BE3, AID-BE3, or APOBEC3G-BE3 as described in the Materials and Methods of Example 17. C-to-T base editing efficiencies are shown. FIG. 140C shows individual DNA sequencing reads from HEK293T cells that were treated with BE3, CDA1-BE3, or AID-BE3 targeting the HEK2 locus and binned according to the sequence of the protospacer and analyzed, revealing that >85% of sequencing reads that have clean C to T edits by CDA1-BE3 and AID-BE3 have both Cs edited to T (FIG. 140C).

Figures 141A, 141B:
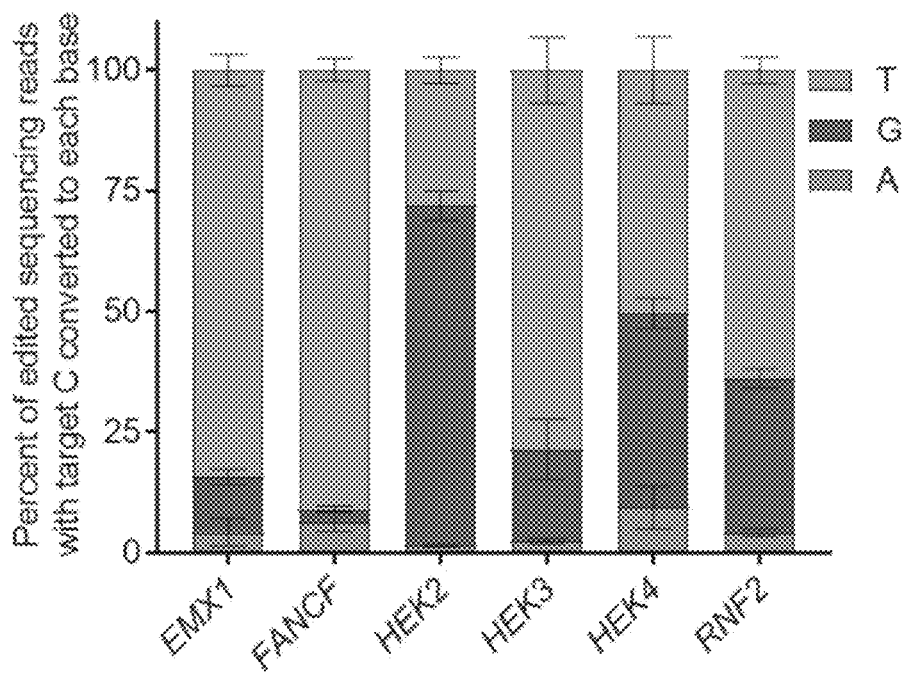
Figure 141C:
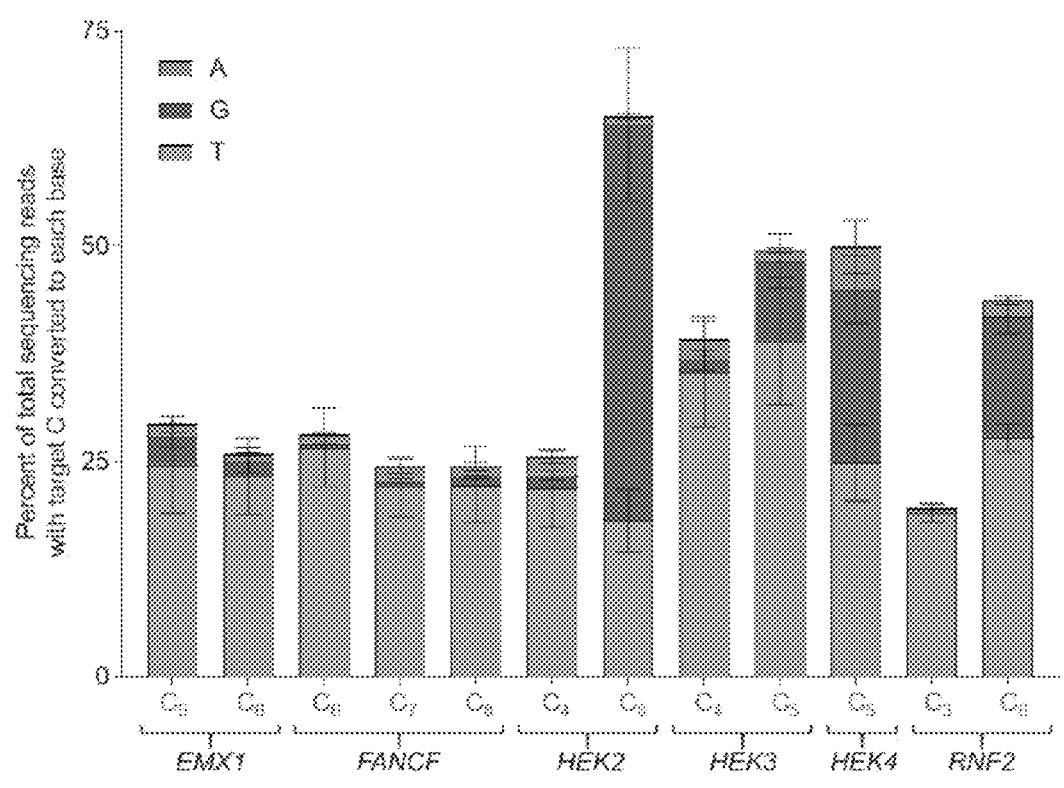

FIGS. 141A to 141C show uneven editing in sites with multiple editable Cs results in lower product purity. FIG. 141A shows protospacers and PAM sequences of genomic loci studied, with the target Cs in FIG. 141C shown in purple and red, and target Cs in FIG. 141B shown in red. FIGS. 141B and 141C show HEK293T cells treated with BE3 as described in the Materials and Methods of Example 17. The product distribution among edited DNA sequencing reads (reads in which the target C is mutated) is shown. C to non-T editing is more frequent when editing efficiencies are unequal for two Cs within the same locus. Values and error bars reflect the mean±S.D. of three independent biological replicates performed on different days.

Figures 142A, 142B:
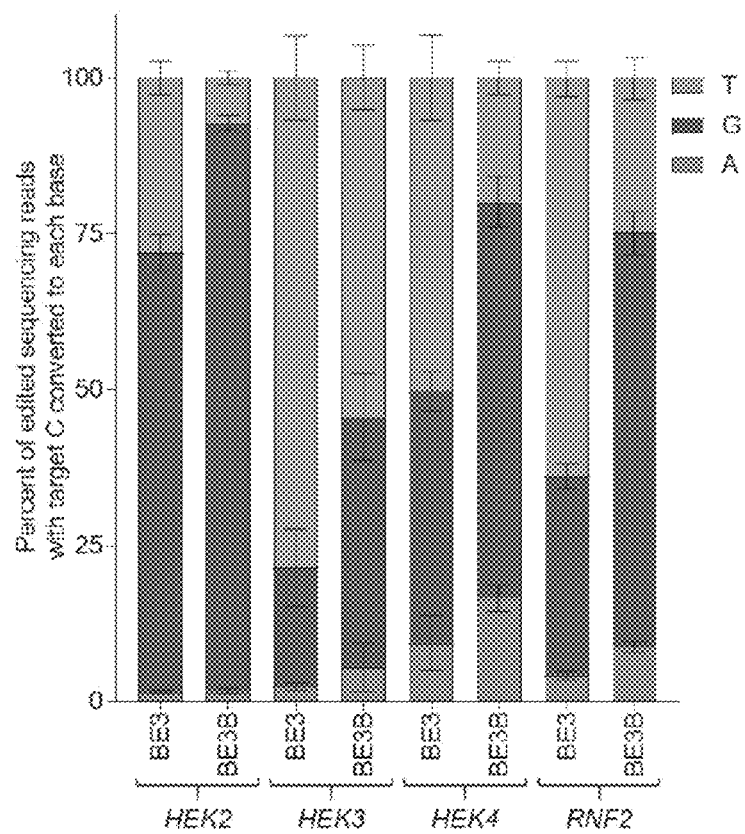
Figure 142C:
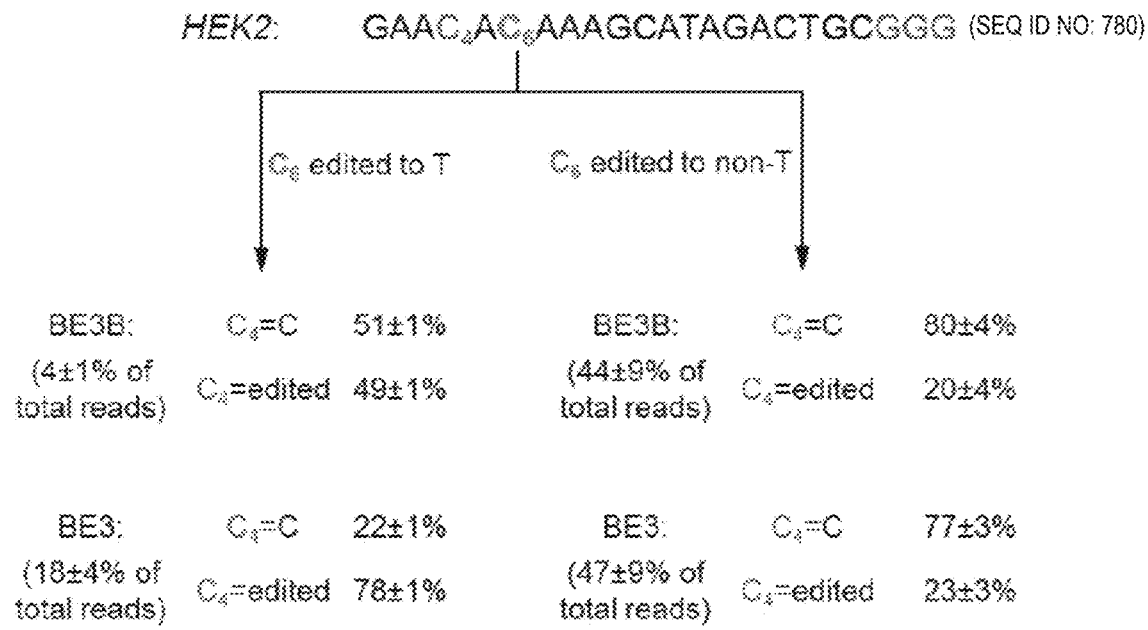
Figure 142D:
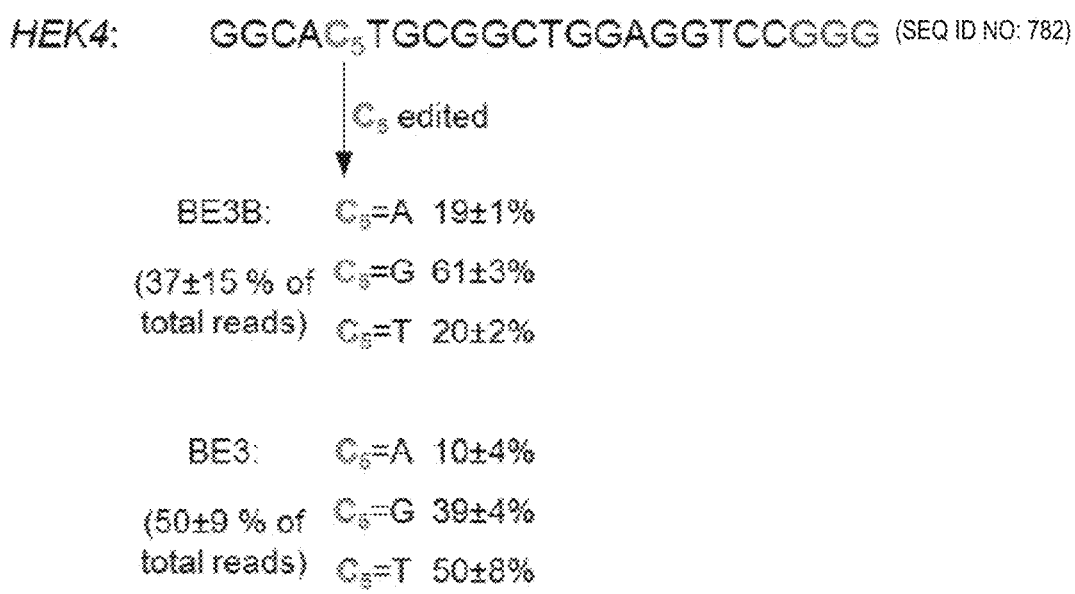

FIGS. 142A to 142D show base editing of multiple Cs results in higher base editing product purity. FIG. 142A shows protospacers and PAM sequences of genomic loci studied, with the target Cs that are investigated in FIG. 142B shown in red. FIG. 142B shows HEK293T cells treated with BE3 or BE3B (which lacks UGI) as described in the Materials and Methods of Example 17. The product distribution among edited DNA sequencing reads (reads in which the target C is mutated) is shown. FIG. 142C shows the HTS reads from HEK293T cells that were treated with BE3 or BE3B (which lacks UGI) targeting the HEK2 locus were binned according to the identity of the primary target C at position 6. The resulting reads were then analyzed for the identity of the base at the secondary target C at position 4. $C_6$ is more likely to be incorrectly edited to a non-T when there is only a single editing event in that read. FIG. 142D shows the distribution of edited reads with A, G, and T at $C_5$ in cells treated with BE3 or BE3B targeting the HEK4 locus (a site with only a single editable C), illustrating that single G:U mismatches are processed via UNG-initiated base excision repair to give a mixture of products. Values and error bars reflect the mean±S.D. of three independent biological replicates performed on different days.

Figure 143:
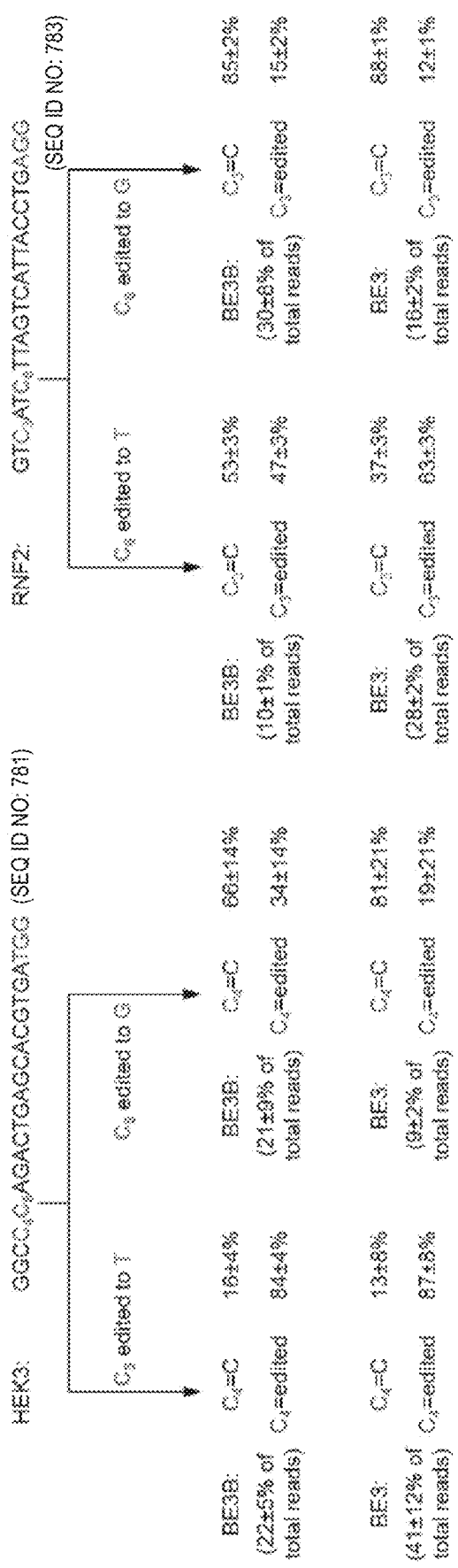

FIG. 143 shows base editing of multiple Cs results in higher base editing product purity at the HEK3 and RNF2 loci. DNA sequencing reads from HEK293T cells treated with BE3 or BE3B (without UGI) targeting the HEK3 and RNF2 loci were separated according to the identity of the base at the primary target C position (in red). The four groups of sequencing reads were then interrogated for the identity of the base at the secondary target C position (in purple). For BE3, when the primary target C (in red) is incorrectly edited to G, the secondary target C is more likely to remain C. Conversely, when the primary target C (in red) is converted to T, the secondary target C is more likely to also be edited to a T in the same sequencing read. Values and error bars reflect the mean±S.D. of three independent biological replicates performed on different days.

FIGS. 144A to 144C show BE4 induces lower indel frequencies than BE3, and Target-AID exhibits similar product purities as CDA1-BE3. FIG. 144A shows HEK293T cells treated with BE3, BE4, or Target-AID as described in the Materials and Methods of Example 17. The frequency of indel formation (see Materials and Methods of Example 17) is shown. FIG. 144B shows HEK293T cells treated with CDA1-BE3 or Target-AID as described in the Materials and Methods of Example 17. The product distribution among edited DNA sequencing reads (reads in which the target C is mutated) is shown. FIG. 144C shows protospacers and PAM sequences of genomic loci studied, with the target Cs that are investigated in FIG. 144B shown in red. Values and error bars reflect the mean±S.D. of three independent biological replicates performed on different days.

FIGS. 145A to 145C show SaBE4 exhibits increased base editing yields and product purities compared to SaBE3. FIG. 145A shows HEK293T cells treated with SaBE3 and SaBE4 as described in the Materials and Methods of Example 17. The percentage of total DNA sequencing reads with Ts at the target positions indicated are shown. FIG. 145B shows protospacers and PAM sequences of genomic loci studied, with the target Cs in FIG. 145A shown in purple and red, with target Cs that are investigated in FIG. 145C shown in red. FIG. 145C shows the product distribution among edited DNA sequencing reads (reads in which the target C is mutated). Values and error bars reflect the mean±S.D. of three independent biological replicates performed on different days.

Figure 146:
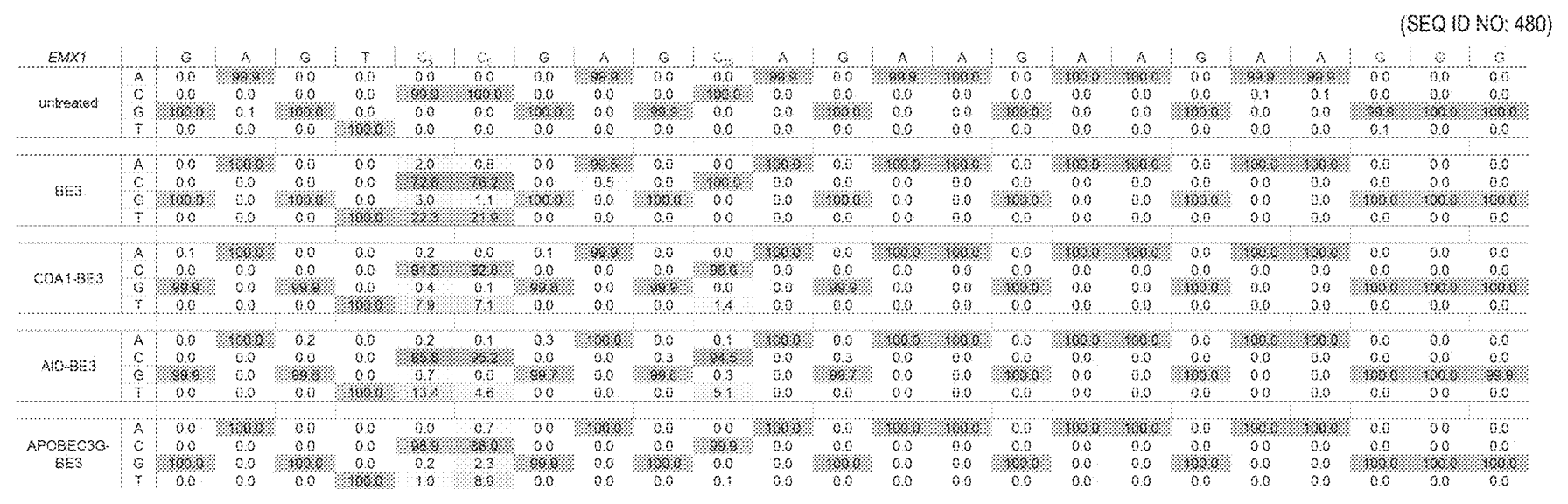

FIG. 146 shows base editing outcomes from treatment with BE3, CDA1-BE3, AID-BE3, or APOBEC3G-BE3 at the EMX1 locus. The sequence of the protospacer is shown at the top, with the PAM and the target bases in red with a subscripted number indicating their positions within the protospacer. Underneath the sequence are the percentages of total sequencing reads with the corresponding base. Cells were treated as described in the Materials and Methods of Example 17. Values shown are from one representative experiment.

Figure 147:
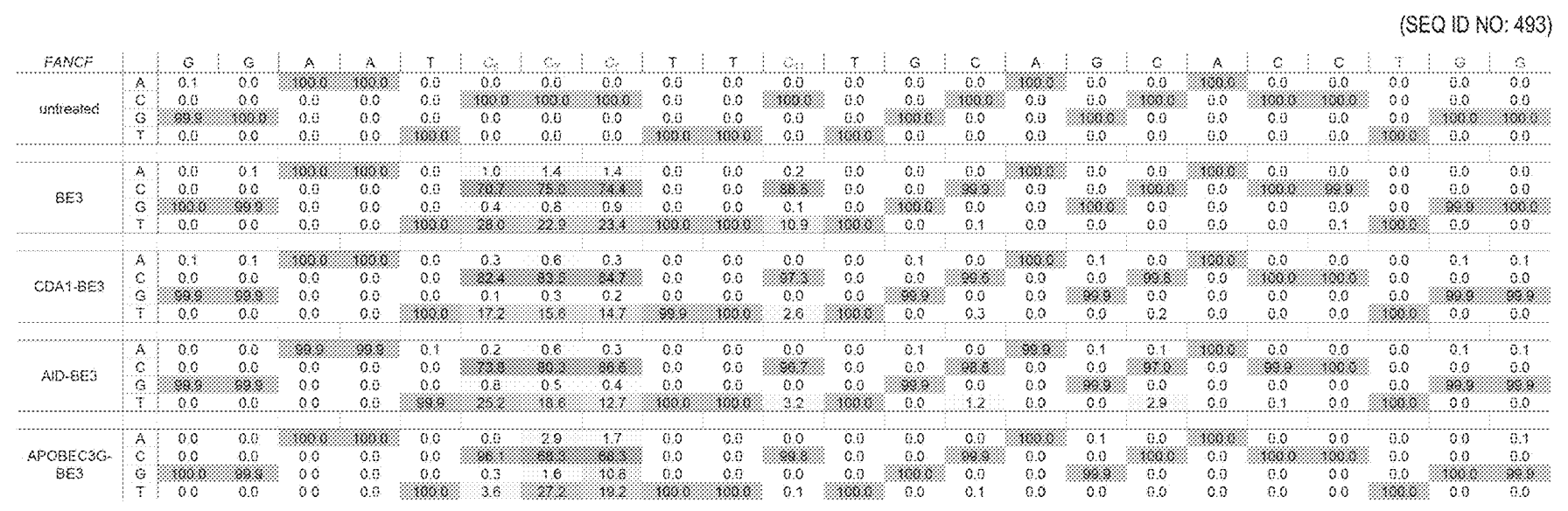

FIG. 147 shows base editing outcomes from treatment with BE3, CDA1-BE3, AID-BE3, or APOBEC3G-BE3 at the FANCF locus. The sequence of the protospacer is shown at the top, with the PAM and the target bases in red with a subscripted number indicating their positions within the protospacer. Underneath the sequence are the percentages of total sequencing reads with the corresponding base. Cells were treated as described in the Materials and Methods of Example 17. Values shown are from one representative experiment.

Figure 148:
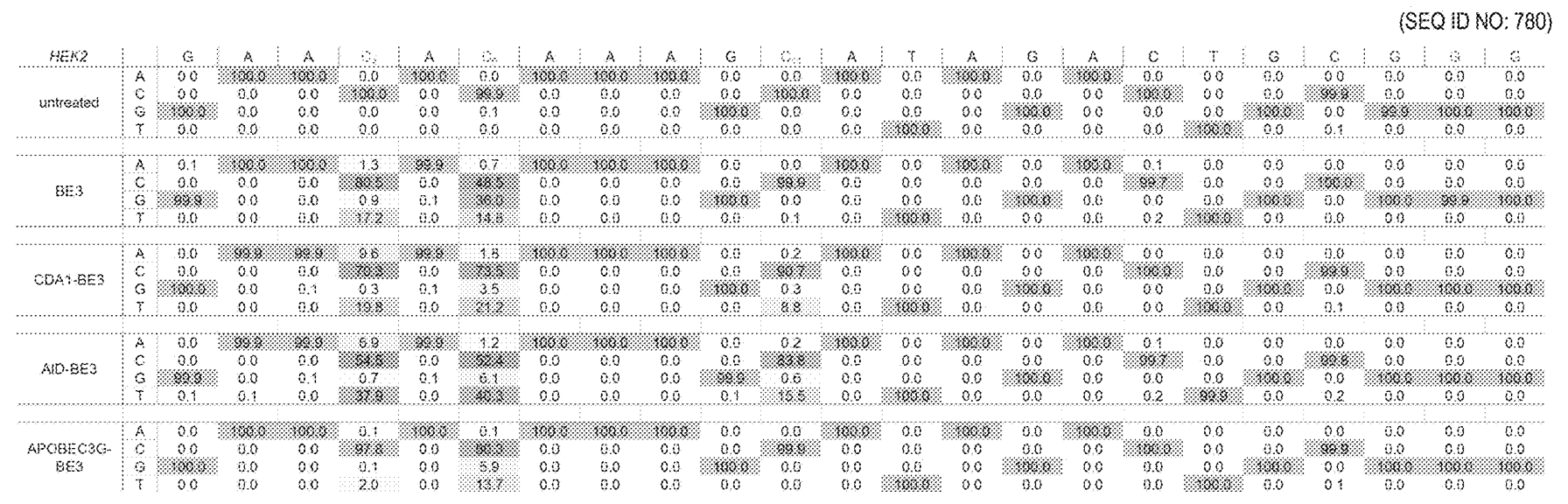

FIG. 148 shows base editing outcomes from treatment with BE3, CDA1-BE3, AID-BE3, or APOBEC3G-BE3 at the HEK2 locus. The sequence of the protospacer is shown at the top, with the PAM and the target bases in red with a subscripted number indicating their positions within the protospacer. Underneath the sequence are the percentages of total sequencing reads with the corresponding base. Cells were treated as described in the Materials and Methods of Example 17. Values shown are from one representative experiment.

Figure 149:
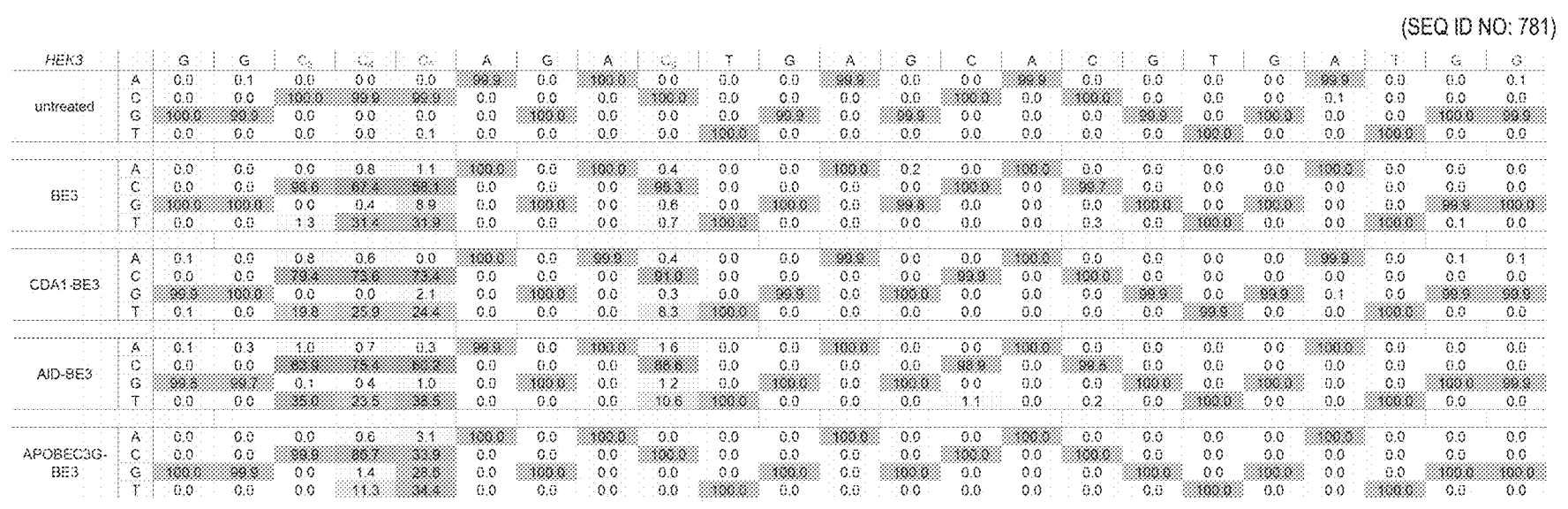

FIG. 149 shows base editing outcomes from treatment with BE3, CDA1-BE3, AID-BE3, or APOBEC3G-BE3 at the HEK3 locus. The sequence of the protospacer is shown at the top, with the PAM and the target bases in red with a subscripted number indicating their positions within the protospacer. Underneath the sequence are the percentages of total sequencing reads with the corresponding base. Cells were treated as described in the Materials and Methods of Example 17. Values shown are from one representative experiment.

Figure 150:
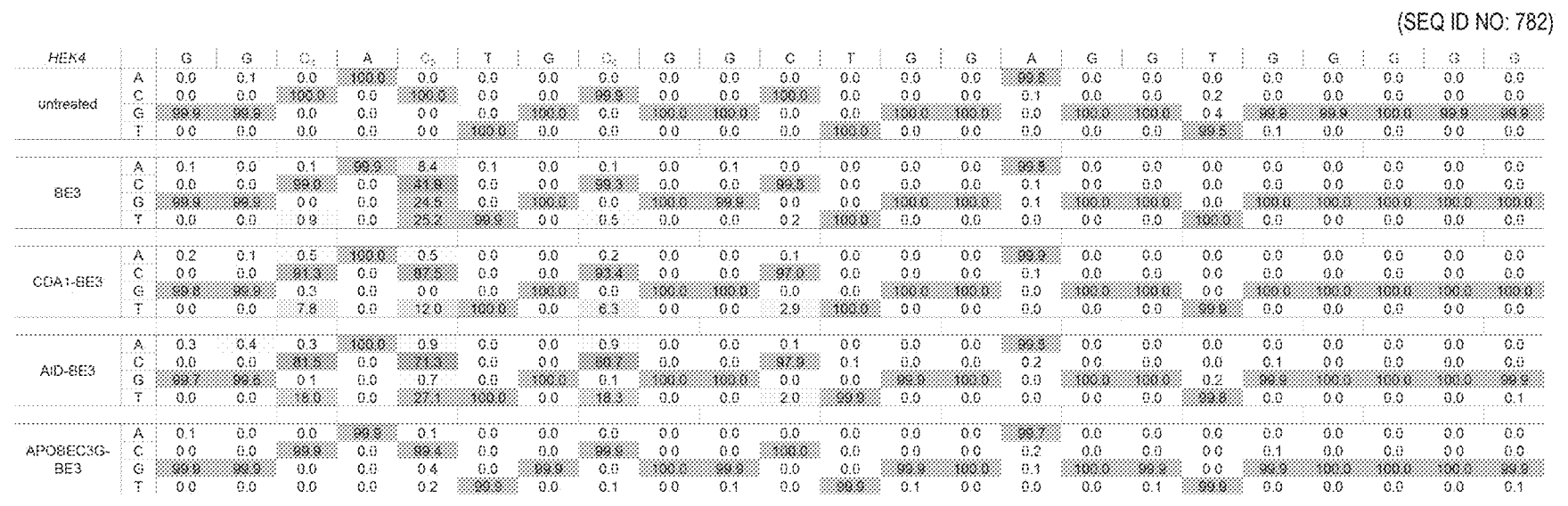

FIG. 150 shows base editing outcomes from treatment with BE3, CDA1-BE3, AID-BE3, or APOBEC3G-BE3 at the HEK4 locus. The sequence of the protospacer is shown at the top, with the PAM and the target bases in red with a subscripted number indicating their positions within the protospacer. Underneath the sequence are the percentages of total sequencing reads with the corresponding base. Cells were treated as described in the Materials and Methods of Example 17. Values shown are from one representative experiment.

Figure 151:
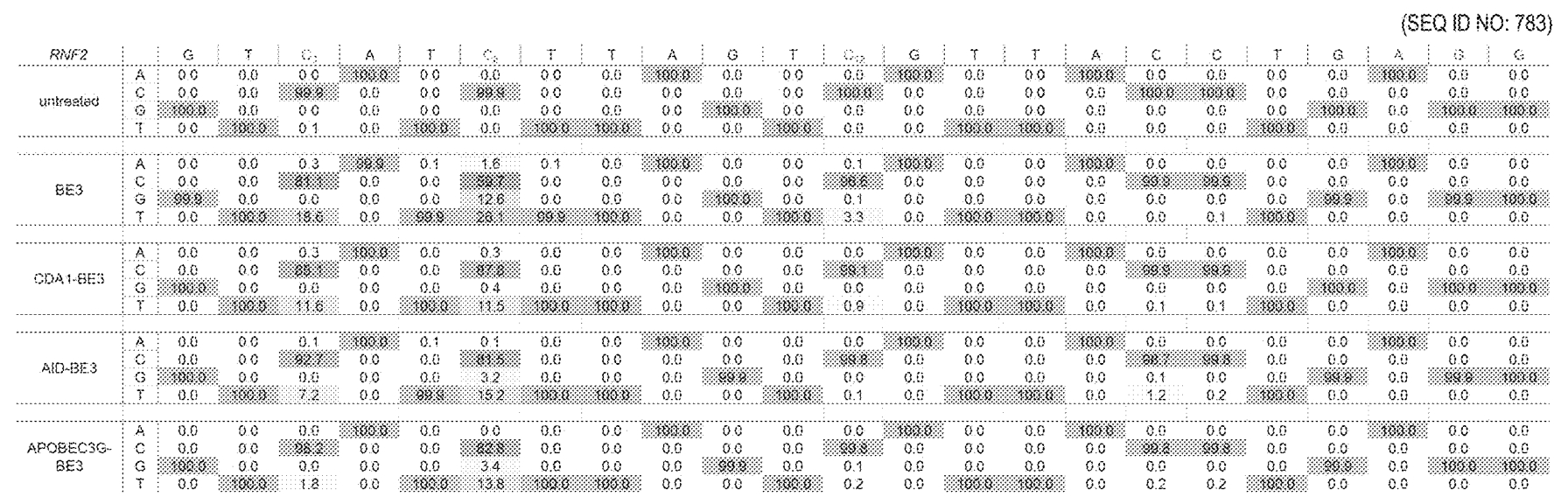

FIG. 151 shows base editing outcomes from treatment with BE3, CDA1-BE3, AID-BE3, or APOBEC3G-BE3 at the RNF2 locus. The sequence of the protospacer is shown at the top, with the PAM and the target bases in red with a subscripted number indicating their positions within the protospacer. Underneath the sequence are the percentages of total sequencing reads with the corresponding base. Cells were treated as described in the Materials and Methods of Example 17. Values shown are from one representative experiment.

Figure 152:
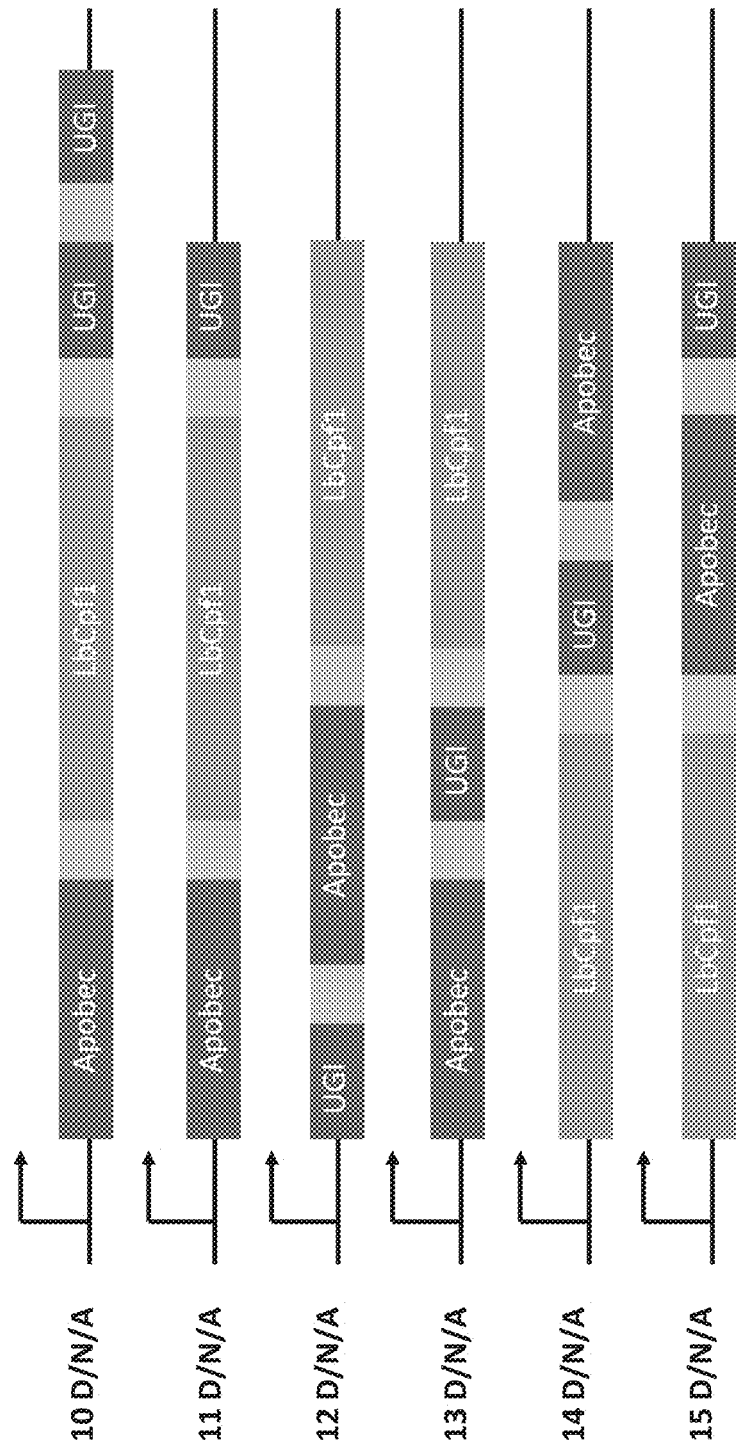

FIG. 152 shows a schematic of LBCpf1 fusion constructs. Construct 10 has a domain arrangement of [Apobec]-[LbCpf1]-[UGI]-[UGI]; construct 11 has a domain arrangement of [Apobec]-[LbCpf1]-[UGI]; construct 12 has a domain arrangement of [UGI]-[Apobec]-[LbCpf1]; construct 13 has a domain arrangement of [Apobec]-[UGI]-[LbCpf1]; construct 14 has a domain arrangement of [LbCpf1]-[UGI]-[Apobec]; construct 15 has a domain arrangement of [LbCpf1]-[Apobec]-[UGI]. For each construct three different LbCpf1 proteins were used (D/N/A, which refers to nuclease dead LbCpf1 (D); LbCpf1 nickase (N) and nuclease active LbCpf1 (A)).

Figure 153:
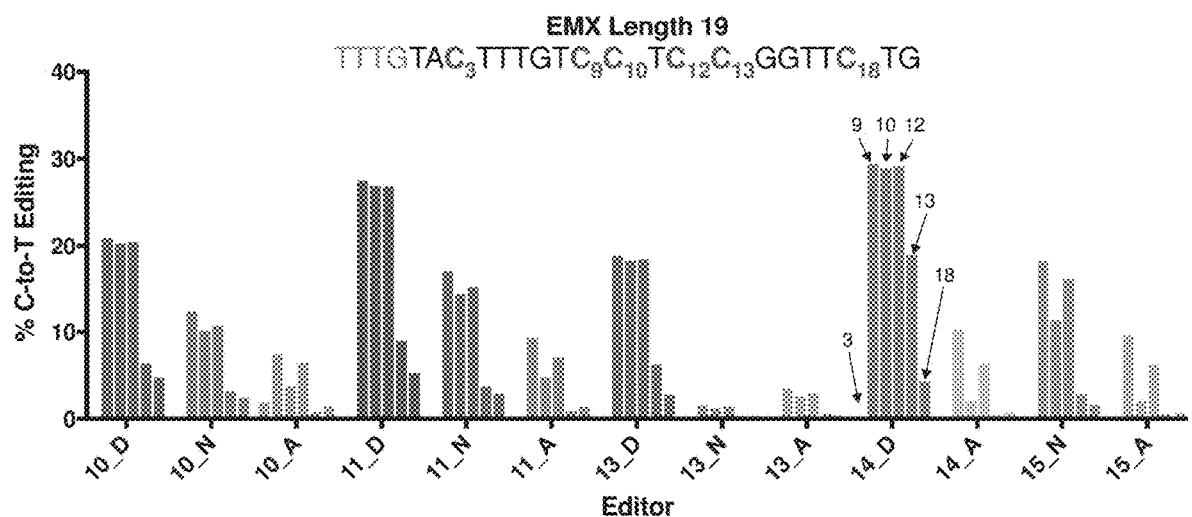

FIG. 153 shows the percentage of C to T editing of six C residues in the EMX target TTTGTAC$_3$TTTGTC$_9$C$_{10}$TC12C$_{13}$GGTTC$_{18}$TG (SEQ ID NO: 738) using a guide of 19 nucleotides in length, i.e., EMX19: TACTTTGTCCTCCGGTTCT (SEQ ID NO: 744). Editing was tested for several of the constructs shown in FIG. 152.

Figure 154:
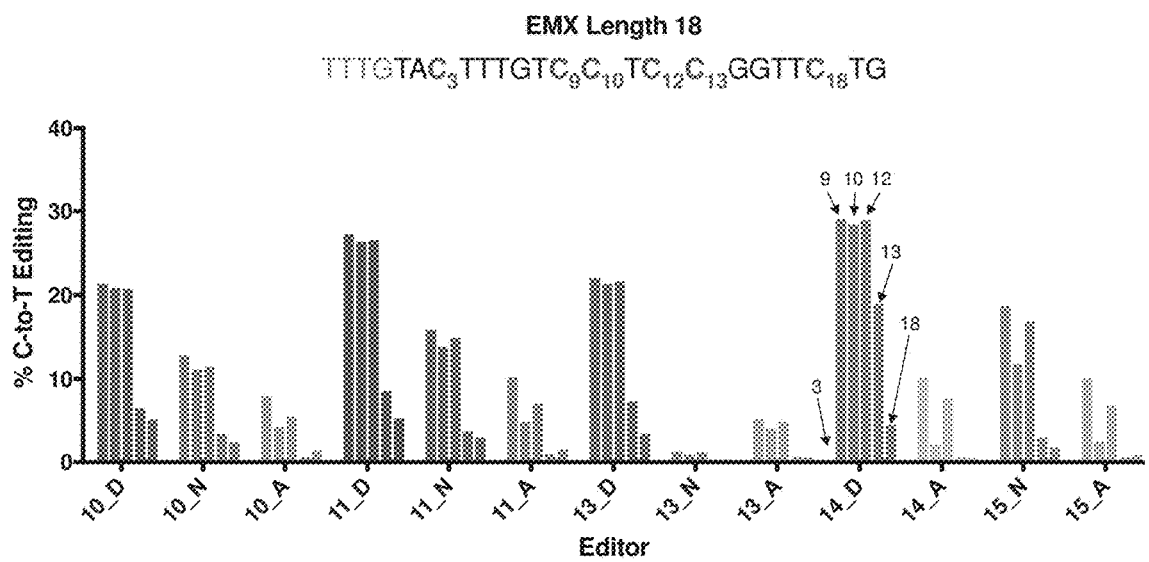

FIG. 154 shows the percentage of C to T editing of six C residues in the EMX target TTTGTAC$_3$TTTGTC$_9$C$_{10}$TC12C$_{13}$GGTTC$_{18}$TG (SEQ ID NO: 738) using a guide of 18 nucleotides in length, i.e., EMX18: TACTTTGTCCTCCGGTTC (SEQ ID NO: 745). Editing was tested for several of the constructs shown in FIG. 152.

Figure 155:
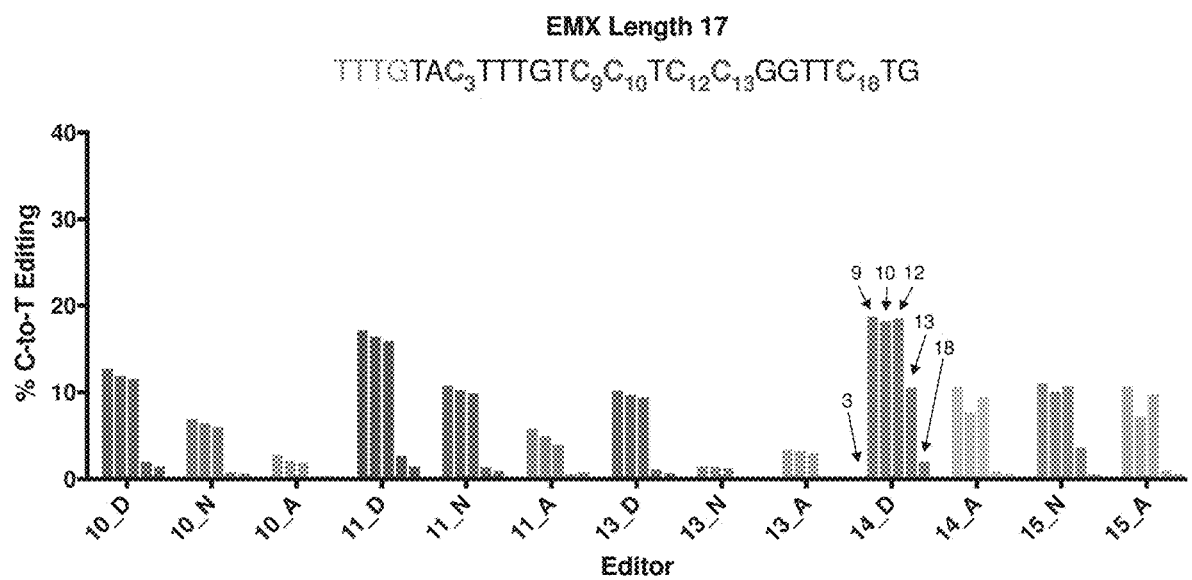

FIG. 155 shows the percentage of C to T editing of six C residues in the EMX target TTTGTAC$_3$TTTGTC$_9$C$_{10}$TC12C$_{13}$GGTTC$_{18}$TG (SEQ ID NO: 738) using a guide of 17 nucleotides in length, i.e., EMX17: TACTTTGTCCTCCGGTT (SEQ ID NO: 746). Editing was tested for several of the constructs shown in FIG. 152.

Figure 156:
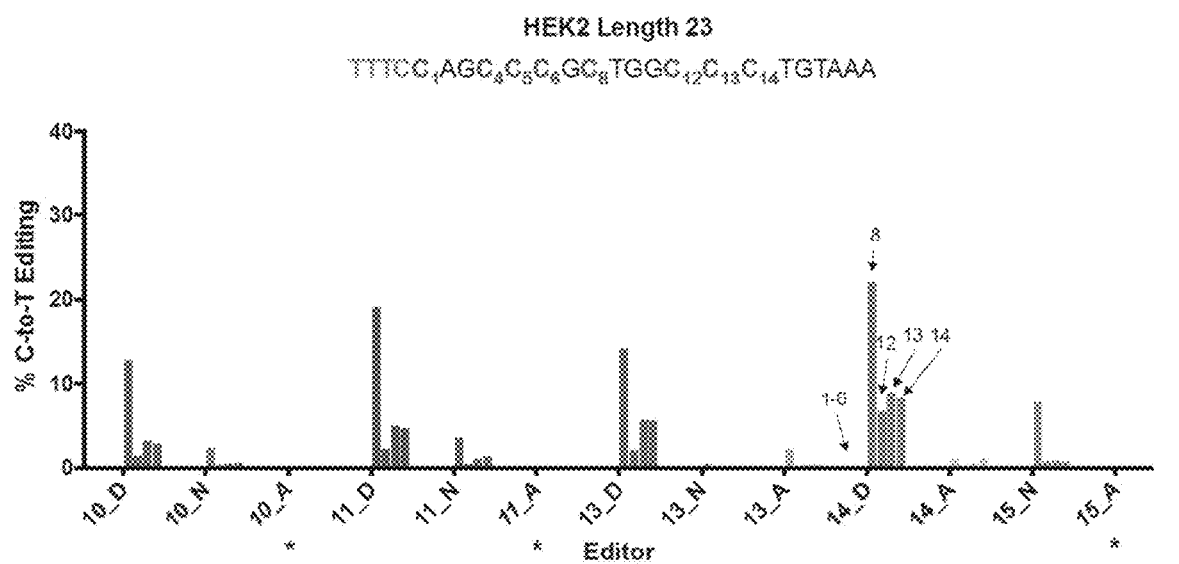

FIG. 156 shows the percentage of C to T editing of eight C residues in the HEK2 target TTTCC$_1$AGC$_4$C$_5$C$_6$GC$_8$TGGC$_{12}$C$_{13}$C$_{14}$TGTAAA (SEQ ID NO: 739) using a guide of 23 nucleotides in length, i.e., Hek2_23: CAGCCCGCTGGCCCTGTAAAGGA (SEQ ID NO: 747). Editing was tested for several of the constructs shown in FIG. 152.

Figure 157:
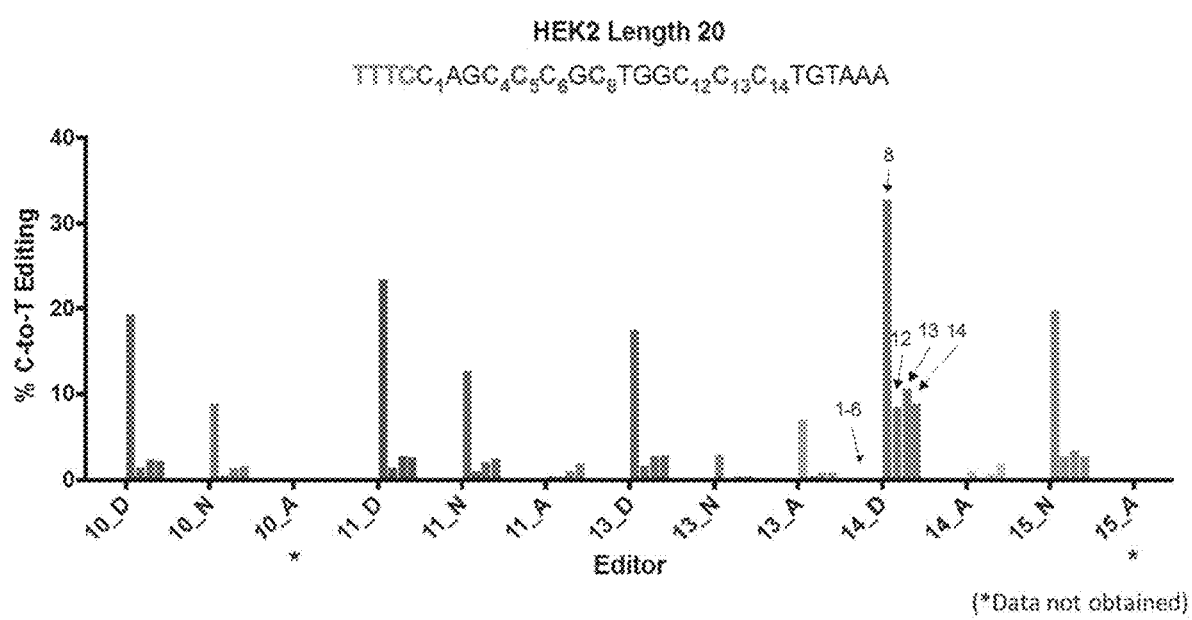

FIG. 157 shows the percentage of C to T editing of eight C residues in the HEK2 target TTTCC$_1$AGC$_4$C$_5$C$_6$GC$_8$TGGC$_{12}$C$_{13}$C$_{14}$TGTAAA (SEQ ID NO: 739) using a guide of 20 nucleotides in length, i.e., Hek2_20: CAGCCCGCTGGCCCTGTAAA (SEQ ID NO: 748). Editing was tested for several of the constructs shown in FIG. 152.

Figure 158:
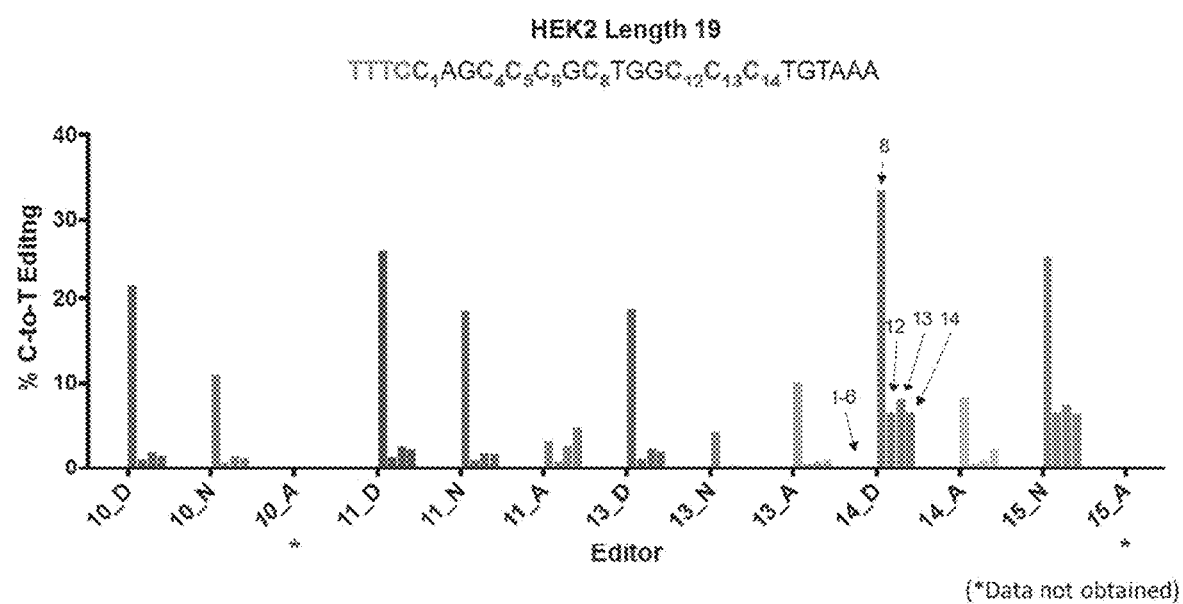

FIG. 158 shows the percentage of C to T editing of eight C residues in the HEK2 target TTTCC$_1$AGC$_4$C$_5$C$_6$GC$_8$TGGC$_{12}$C$_{13}$C$_{14}$TGTAAA (SEQ ID NO: 739) using a guide of 19 nucleotides in length, i.e., Hek2_19: CAGCCCGCTGGCCCTGTAA (SEQ ID NO: 749). Editing was tested for several of the constructs shown in FIG. 152.

Figure 159:
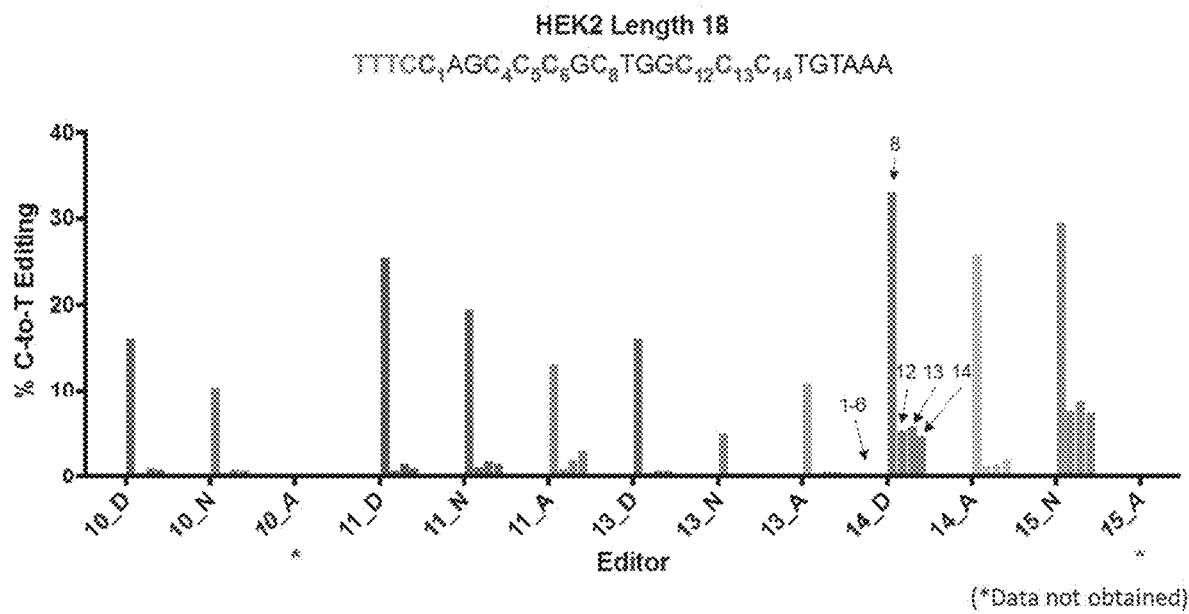

FIG. 159 shows the percentage of C to T editing of eight C residues in the HEK2 target TTTCC$_1$AGC$_4$C$_5$C$_6$GC$_8$TGGC$_{12}$C$_{13}$C$_{14}$TGTAAA (SEQ ID NO: 739) using a guide of 18 nucleotides in length, i.e., Hek2_18: CAGCCCGCTGGCCCTGTA (SEQ ID NO: 750). Editing was tested for several of the constructs shown in FIG. 152.

FIG. 160 shows the editing percentage values (after adjustment based on indel count), and the percentage of indels for the experiments depicted in FIG. 153.

FIG. 161 shows the editing percentage values (after adjustment based on indel count), and the percentage of indels for the experiments depicted in FIG. 154.

FIG. 162 shows the editing percentage values (after adjustment based on indel count), and the percentage of indels for the experiments depicted in FIG. 155.

FIG. 163 shows the editing percentage values (after adjustment based on indel count), and the percentage of indels for the experiments depicted in FIG. 156.

FIG. 164 shows the editing percentage values (after adjustment based on indel count), and the percentage of indels for the experiments depicted in FIG. 157.

FIG. 165 shows the editing percentage values (after adjustment based on indel count), and the percentage of indels for the experiments depicted in FIG. 158.

FIG. 166 shows the editing percentage values (after adjustment based on indel count), and the percentage of indels for the experiments depicted in FIG. 159.

DEFINITIONS

As used herein and in the claims, the singular forms "a," "an," and "the" include the singular and the plural reference unless the context clearly indicates otherwise. Thus, for example, a reference to "an agent" includes a single agent and a plurality of such agents.

The term "nucleic acid programmable DNA binding protein" or "napDNAbp" refers to a protein that associates with a nucleic acid (e.g., DNA or RNA), such as a guide nucleic acid (e.g., gRNA), that guides the napDNAbp to a specific nucleic acid sequence, for example, by hybridinzing to the target nucleic acid sequence. For example, a Cas9 protein can associate with a guide RNA that guides the Cas9 protein to a specific DNA sequence is has complementary to the guide RNA. In some embodiments, the napDNAbp is a class 2 microbial CRISPR-Cas effector. In some embodiments, the napDNAbp is a Cas9 domain, for example, a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNA binding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically described in this disclosure.

In some embodiments, the napDNAby is an "RNA-programmable nuclease" or "RNA-guided nuclease." The terms are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is also used to refer to guide RNAs that exist as either single molecules or as a complex of two or more molecules. Typically, gRNAs that exist as a single RNA species comprise two domains: (1) a domain that shares homology to a target nucleic acid (i.e., directs binding of a Cas9 complex to the target); and (2) a domain that binds a Cas9 protein. In some embodiments, domain (2) corresponds to a sequence known as a tracrRNA and comprises a stem-loop structure. In some embodiments, domain (2) is identical or homologous to a tracrRNA as provided in Jinek et al., Science 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. Science 337:816-821 (2012), the entire contents of each of which are incorporated herein by reference.

In some embodiments, any of the sgRNAs provided herein comprise a sequence, e.g., a sgRNA backbone sequence that binds to a napDNAbp. For example sgRNAs have been described in Jinek M, Chylinski K, Fonfara I, Hauer M, Doudna J A, and Charpentier E (2012) A programmable dual-RNA-guided DNA endonuclease in adaptive bacterial immunity. Science, 337, 816-812; Mali P, Esvelt K M, Church G M (2013) Cas9 as a versatile tool for engineering biology. Nature Methods, 10, 957-963; Li J F, Norville J E, Aach J, McCromack M, Zhang D, Bush J, Church G M, and Sheen J (2013) Multiplex and homologous recombination-mediated genome editing in *Arabidopsis* and *Nicotiana benthamiana* using guide RNA and Cas9. Nature Biotech, 31, 688-691; Hwang W Y, Fu Y, Reyon D, Maeder M L, Tsai S Q, Sander J D, Peterson R T, Yeh J R J, Joung J K (2013) Efficient in vivo genome editing using RNA-guided nucleases. Nat Biotechnol, 31, 227-229; Cong L, Ran F A, Cox D, Lin S, Barretto R, Habib N, Hsu P D, Wu X, Jiang W, Marraffini L A, Zhang F (2013) Multiplex genome engineering using CRIPSR/Cas systems. Science, 339, 819-823; Cho S W, Kim S, Kim J M, Kim J S (2013) Targeted genome engineering in human cells with the Cas9 RNA-guided endonuclease. Nat Biotechnol, 31, 230-232; Jinek M J, East A, Cheng A, Lin S, Ma E, Doudna J (2013) RNA-programmed genome editing in human cells. eLIFE, 2:e00471; DiCarlo J E, Norville J E, Mali P, Rios, Aach J, Church G M (2013) Genome engineering in *Saccharomyces* cerevisiae using CRISPR-Cas systems. Nucl Acids Res, 41, 4336-4343; Briner A E, Donohoue P D, Gomaa A A, Selle K, Slorach E M, Nye C H, Haurwitz R E, Beisel C L, May A P, and Barrangou R (2014) Guide RNA functional modules direct Cas9 activity and orthogonality. Mol Cell, 56, 333-339; the contents of each of which are incorporated herein by reference. In some embodiments, any of the gRNAs (e.g., sgRNAs) provided herein comprise the nucleic acid sequence of GTAATTTCTACTAAGTGTAGAT (SEQ ID NO: 741), wherein each of the Ts of SEQ ID NO: 741 are uracil (U), i.e., GUAAUUUCUACUAAGUGUAGAU, or the sequence GUUUUAGAGCUAGAAAUAGCAAGUUAAAAUAAGGCUAGUCCGUUAUCAACUUG AAAAAGUGGCACCGAGUCGGUGCUUUUU-3' (SEQ ID NO: 618).

Because RNA-programmable nucleases (e.g., Cas9) use RNA:DNA hybridization to target DNA cleavage sites, these proteins are able to target, in principle, any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. *Science* 339, 819-823 (2013); Mali, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al., Genome engineering in *Saccharomyces cerevisiae* using CRISPR-Cas systems. *Nucleic Acids Research* (2013); Jiang, W. et al., RNA-guided editing of bacterial genomes using CRISPR-Cas systems. *Nature Biotechnology* 31, 233-239 (2013); the entire contents of each of which are incorporated herein by reference).

The term "Cas9" or "Cas9 nuclease" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science*. 337:816-821(2012); Qi et al., "Repurposing CRISPR as an RNA-Guided Platform for Sequence-Specific Control of Gene Expression" (2013) Cell. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., Cell. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, SEQ ID NO: 1 (nucleotide); SEQ ID NO: 2 (amino acid)).

```
                                              (SEQ ID NO: 1)
ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT

CTTTTATTTGGCAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAAATTGGCAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAATCTACAATCAATTATTTGAAGAAAACCCT

ATTAACGCAAGTAGAGTAGATGCTAAAGCGATTCTTTCTGCACGATTGAG

TAAATCAAGACGATTAGAAAATCTCATTGCTCAGCTCCCCGGTGAGAAGA

GAAATGGCTTGTTTGGGAATCTCATTGCTTTGTCATTGGGATTGACCCCT

AATTTTAAATCAAATTTTGATTTGGCAGAAGATGCTAAATTACAGCTTTC

AAAAGATACTTACGATGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATAGTGAAATAACTAAGGCTCCCCT

ATCAGCTTCAATGATTAAGCGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGGAGC

TAGCCAAGAAGAATTTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAGAAGATTGAAAAAATCTTGACTTTTCGAATTCCTTAT

TATGTTGGTCCATTGGCGCGTGGCAATAGTCGTTTTGCATGGATGACTCG

GAAGTCTGAAGAAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAGTACTACCAAAACATAGTTTGCTTTATGAGTA

TTTTACGGTTTATAACGAATTGACAAAGGTCAAATATGTTACTGAGGGAA

TGCGAAAACCAGCATTTCTTTCAGGTGAACAGAAGAAAGCCATTGTTGAT

TTACTCTTCAAAACAAATCGAAAAGTAACCGTTAAGCAATTAAAAGAAGA

TTATTTCAAAAAAATAGAATGTTTTGATAGTGTTGAAATTTCAGGAGTTG

AAGATAGATTTAATGCTTCATTAGGCGCCTACCATGATTTGCTAAAAATT

ATTAAAGATAAAGATTTTTTGGATAATGAAGAAAATGAAGATATCTTAGA

GGATATTGTTTTAACATTGACCTTATTTGAAGATAGGGGGATGATTGAGG

AAAGACTTAAAACATATGCTCACCTCTTTGATGATAAGGTGATGAAACAG

CTTAAACGTCGCCGTTATACTGGTTGGGGACGTTTGTCTCGAAAATTGAT

TAATGGTATTAGGGATAAGCAATCTGGCAAAACAATATTAGATTTTTGA

AATCAGATGGTTTTGCCAATCGCAATTTTATGCAGCTGATCCATGATGAT

AGTTTGACATTTAAAGAAGATATTCAAAAAGCACAGGTGTCTGGACAAGG

CCATAGTTTACATGAACAGATTGCTAACTTAGCTGGCAGTCCTGCTATTA

AAAAAGGTATTTTACAGACTGTAAAAATTGTTGATGAACTGGTCAAAGTA

ATGGGGCATAAGCCAGAAAATATCGTTATTGAAATGGCACGTGAAAATCA

GACAACTCAAAAGGGCCAGAAAAATTCGCGAGAGCGTATGAAACGAATCG

AAGAAGGTATCAAAGAATTAGGAAGTCAGATTCTTAAAGAGCATCCTGTT

GAAAATACTCAATTGCAAATGAAAAGCTCTATCTCTATTATCTACAAAA

TGGAAGAGACATGTATGTGGACCAAGAATTAGATATTAATCGTTTAAGTG

ATTATGATGTCGATCACATTGTTCCACAAAGTTTCATTAAAGACGATTCA

ATAGACAATAAGGTACTAACGCGTTCTGATAAAAATCGTGGTAAATCGGA

TAACGTTCCAAGTGAAGAAGTAGTCAAAAAGATGAAAAACTATTGGAGAC

AACTTCTAAACGCCAAGTTAATCACTCAACGTAAGTTTGATAATTTAACG

AAAGCTGAACGTGGAGGTTTGAGTGAACTTGATAAAGCTGGTTTTATCAA

ACGCCAATTGGTTGAAACTCGCCAAATCACTAAGCATGTGGCACAAATTT

TGGATAGTCGCATGAATACTAAATACGATGAAAATGATAAACTTATTCGA

GAGGTTAAAGTGATTACCTTAAAATCTAAATTAGTTTCTGACTTCCGAAA

AGATTTCCAATTCTATAAAGTACGTGAGATTAACAATTACCATCATGCCC

ATGATGCGTATCTAAATGCCGTCGTTGGAACTGCTTTGATTAAGAAATAT

CCAAAACTTGAATCGGAGTTTGTCTATGGTGATTATAAAGTTTATGATGT

TCGTAAAATGATTGCTAAGTCTGAGCAAGAAATAGGCAAAGCAACCGCAA

AATATTTCTTTTACTCTAATATCATGAACTTCTTCAAAACAGAAATTACA

CTTGCAAATGGAGAGATTCGCAAACGCCCTCTAATCGAAACTAATGGGGA

AACTGGAGAAATTGTCTGGGATAAAGGGCGAGATTTTGCCACAGTGCGCA

AAGTATTGTCCATGCCCCAAGTCAATATTGTCAAGAAAACAGAAGTACAG
```

```
ACAGGCGGATTCTCCAAGGAGTCAATTTTACCAAAAAGAAATTCGGACAA

GCTTATTGCTCGTAAAAAAGACTGGGATCCAAAAAAATATGGTGGTTTTG

ATAGTCCAACGGTAGCTTATTCAGTCCTAGTGGTTGCTAAGGTGGAAAAA

GGGAAATCGAAGAAGTTAAAATCCGTTAAAGAGTTACTAGGGATCACAAT

TATGGAAAGAAGTTCCTTTGAAAAAAATCCGATTGACTTTTTAGAAGCTA

AAGGATATAAGGAAGTTAAAAAAGACTTAATCATTAAACTACCTAAATAT

AGTCTTTTTGAGTTAGAAAACGGTCGTAAACGGATGCTGGCTAGTGCCGG

AGAATTACAAAAGGAAATGAGCTGGCTCTGCCAAGCAAATATGTGAATT

TTTTATATTTAGCTAGTCATTATGAAAAGTTGAAGGGTAGTCCAGAAGAT

AACGAACAAAAACAATTGTTTGTGGAGCAGCATAAGCATTATTTAGATGA

GATTATTGAGCAAATCAGTGAATTTTCTAAGCGTGTTATTTTAGCAGATG

CCAATTTAGATAAAGTTCTTAGTGCATATAACAAACATAGAGACAAACCA

ATACGTGAACAAGCAGAAAATATTATTCATTTATTTACGTTGACGAATCT

TGGAGCTCCCGCTGCTTTTAAATATTTTGATACAACAATTGATCGTAAAC

GATATACGTCTACAAAAGAAGTTTTAGATGCCACTCTTATCCATCAATCC

ATCACTGGTCTTTATGAAACACGCATTGATTTGAGTCAGCTAGGAGGTGA

CTGA
```

(SEQ ID NO: 2)
MDKK<u>YSIGLDIGTNSVGWAVITDDYKVPSKKFKVLGNTDRHSIKKNLIGA</u>

<u>LLFGSGET</u>AEATRLKRTARRRYTRRKNRICYLQEIFSNEMAKVDDSFFHR

LEESFLVEEDKKHERHPIFGNIVDEVAYHEKYPTIYHLRKKLADSTDKAD

LRLIYLALAHMIKFRGHFLIEGDLNPDNSDVDKLFIQLVQIYNQLFEENP

INASRVDAKAILSARLSKSRRLENLIAQLPGEKRNGLFGNLIALSLGLTP

NFKSNFDLAEDAKLQLSKDTYDDDLDNLLAQIGDQYADLFLAAKNLSDAI

LLSDILRVNSEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGAYHDLLKI

IKDKDFLDNEENEDILEDIVLTLTLFEDRGMIEERLKTYAHLFDDKVMKQ

LKRRRYTGWGRLSRKLINGIRDKQSGKTILDFLKSDGFANRNFMQLIHDD

SLTFKEDIQKAQVSGQG<u>HSLHEQIANLAGSPAIKKGILQTVKIVDELVKV</u>

<u>MGHKPENIVIEMAR</u>ENQTTQK<u>GQKNSRERMKRIEEGIKELGSQILKEHPV</u>

<u>ENTQLQNEKLYLYYLQNGRDMYVDQELDINRLSDYDVDHIVPQSFIKDDS</u>

<u>IDNKVLTRSDKNRGKSDNVPSEEVVKKMKNYWRQLLNAKLITQRKFDNLT</u>

<u>KAERGGLSELDKAGFIKRQLVETRQITKHVAQILDSRMNTKYDENDKLIR</u>

<u>EVKVITLKSKLVSDFRKDFQFYKVREINNYHHAHDAYLNAVVGTALIKKY</u>

<u>PKLESEFVYGDYKVYDVRKMIAKSEQEIGKATAKYFFYSNIMNFFKTEIT</u>

<u>LANGEIRKRPLIETNGETGEIVWDKGRDFATVRKVLSMPQVNIVKKTEVQ</u>

<u>TGGFSKESILPKRNSDKLIARKKDWDPKKYGGFDSPTVAYSVLVVAKVEK</u>

<u>GKSKKLKSVKELLGITIMERSSFEKNPIDFLEAKGYKEVKKDLIIKLPKY</u>

<u>SLFELENGRKRMLASAGELQKGNELALPSKYVNFLYLASHYEKLKGSPED</u>

<u>NEQKQLFVEQHKHYLDEIIEQISEFSKRVILADANLDKVLSAYNKHRDKP</u>

<u>IREQAENIIHLFTLTNLGAPAAFKYFDTTIDRKRYTSTKEVLDATLIHQS</u>

<u>ITGLYETRIDLSQLGGD</u>

(single underline: HNH domain; double underline: RuvC domain)

In some embodiments, wild type Cas9 corresponds to, or comprises SEQ ID NO:3 (nucleotide) and/or SEQ ID NO: 4 (amino acid):

```
(SEQ ID NO: 3)
ATGGATAAAAAGTATTCTATTGGTTTAGACATCGGCACTAATTCCGTTGG

ATGGGCTGTCATAACCGATGAATACAAAGTACCTTCAAAGAAATTTAAGG

TGTTGGGGAACACAGACCGTCATTCGATTAAAAAGAATCTTATCGGTGCC

CTCCTATTCGATAGTGGCGAAACGGCAGAGGCGACTCGCCTGAAACGAAC

CGCTCGGAGAAGGTATACACGTCGCAAGAACCGAATATGTTACTTACAAG

AAATTTTTAGCAATGAGATGGCCAAAGTTGACGATTCTTTCTTTCACCGT

TTGGAAGAGTCCTTCCTTGTCGAAGAGGACAAGAAACATGAACGGCACCC

CATCTTTGGAAACATAGTAGATGAGGTGGCATATCATGAAAAGTACCCAA

CGATTTATCACCTCAGAAAAAAGCTAGTTGACTCAACTGATAAAGCGGAC

CTGAGGTTAATCTACTTGGCTCTTGCCCATATGATAAAGTTCCGTGGGCA

CTTTCTCATTGAGGGTGATCTAAATCCGGACAACTCGGATGTCGACAAAC

TGTTCATCCAGTTAGTACAAATCTATAATCAGTTGTTTGAAGAGAACCCT

ATAAATGCAAGTGGCGTGGATGCGAAGGCTATTCTTAGCGCCCGCCTCTC

TAAATCCCGACGGCTAGAAAACCTGATCGCACAATTACCCGGAGAGAAGA

AAAATGGGTTGTTCGGTAACCTTATAGCGCTCTCACTAGGCCTGACACCA

AATTTTAAGTCGAACTTCGACTTAGCTGAAGATGCCAAATTGCAGCTTAG

TAAGGACACGTACGATGACGATCTCGACAATCTACTGGCACAAATTGGAG

ATCAGTATGCGGACTTATTTTTGGCTGCCAAAAACCTTAGCGATGCAATC

CTCCTATCTGACATACTGAGAGTTAATACTGAGATTACCAAGGCGCCGTT

ATCCGCTTCAATGATCAAAAGGTACGATGAACATCACCAAGACTTGACAC

TTCTCAAGGCCCTAGTCCGTCAGCAACTGCCTGAGAAATATAAGGAAATA

TTCTTTGATCAGTCGAAAAACGGGTACGCAGGTTATATTGACGGCGGAGC

GAGTCAAGAGGAATTCTACAAGTTTATCAAACCCATATTAGAGAAGATGG

ATGGGACGGAAGAGTTGCTTGTAAAACTCAATCGCGAAGATCTACTGCGA

AAGCAGCGGACTTTCGACAACGGTAGCATTCCACATCAAATCCACTTAGG

CGAATTGCATGCTATACTTAGAAGGCAGGAGGATTTTTATCCGTTCCTCA

AAGACAATCGTGAAAAGATTGAGAAAATCCTAACCTTTCGCATACCTTAC

TATGTGGGACCCCTGGCCCGAGGGAACTCTCGGTTCGCATGGATGACAAG

AAAGTCCGAAGAAACGATTACTCCATGGAATTTTGAGGAAGTTGTCGATA

AAGGTGCGTCAGCTCAATCGTTCATCGAGAGGATGACCAACTTTGACAAG
```

```
AATTTACCGAACGAAAAAGTATTGCCTAAGCACAGTTTACTTTACGAGTA
TTTCACAGTGTACAATGAACTCACGAAAGTTAAGTATGTCACTGAGGGCA
TGCGTAAACCCGCCTTTCTAAGCGGAGAACAGAAGAAAGCAATAGTAGAT
CTGTTATTCAAGACCAACCGCAAAGTGACAGTTAAGCAATTGAAAGAGGA
CTACTTTAAGAAAATTGAATGCTTCGATTCTGTCGAGATCTCCGGGGTAG
AAGATCGATTTAATGCGTCACTTGGTACGTATCATGACCTCCTAAAGATA
ATTAAAGATAAGGACTTCCTGGATAACGAAGAGAATGAAGATATCTTAGA
AGATATAGTGTTGACTCTTACCCTCTTTGAAGATCGGGAAATGATTGAGG
AAAGACTAAAAACATACGCTCACCTGTTCGACGATAAGGTTATGAAACAG
TTAAAGAGGCGTCGCTATACGGGCTGGGGACGATTGTCGCGGAAACTTAT
CAACGGGATAAGAGACAAGCAAAGTGGTAAAACTATTCTCGATTTTCTAA
AGAGCGACGGCTTCGCCAATAGGAACTTTATGCAGCTGATCCATGATGAC
TCTTTAACCTTCAAAGAGGATATACAAAAGGCACAGGTTTCCGGACAAGG
GGACTCATTGCACGAACATATTGCGAATCTTGCTGGTTCGCCAGCCATCA
AAAAGGGCATACTCCAGACAGTCAAAGTAGTGGATGAGCTAGTTAAGGTC
ATGGGACGTCACAAACCGGAAAACATTGTAATCGAGATGGCACGCGAAAA
TCAAACGACTCAGAAGGGGCAAAAAAACAGTCGAGAGCGGATGAAGAGAA
TAGAAGAGGGTATTAAAGAACTGGGCAGCCAGATCTTAAAGGAGCATCCT
GTGGAAAATACCCAATTGCAGAACGAGAAACTTTACCTCTATTACCTACA
AAATGGAAGGGACATGTATGTTGATCAGGAACTGGACATAAACCGTTTAT
CTGATTACGACGTCGATACATTGTACCCCAATCCTTTTTGAAGGACGAT
TCAATCGACAATAAAGTGCTTACACGCTCGGATAAGAACCGAGGGAAAAG
TGACAATGTTCCAAGCGAGGAAGTCGTAAAGAAAATGAAGAACTATTGGC
GGCAGCTCCTAAATGCGAAACTGATAACGCAAAGAAAGTTCGATAACTTA
ACTAAAGCTGAGAGGGGTGGCTTGTCTGAACTTGACAAGGCCGGATTTAT
TAAACGTCAGCTCGTGGAAACCCGCCAAATCACAAAGCATGTTGCACAGA
TACTAGATTCCCGAATGAATACGAAATACGACGAGAACGATAAGCTGATT
CGGGAAGTCAAAGTAATCACTTTAAAGTCAAAATTGGTGTCGGACTTCAG
AAAGGATTTTCAATTCTATAAAGTTAGGGAGATAAATAACTACCACCATG
CGCACGACGCTTATCTTAATGCCGTCGTAGGGACCGCACTCATTAAGAAA
TACCCGAAGCTAGAAAGTGAGTTTGTGTATGGTGATTACAAAGTTTATGA
CGTCCGTAAGATGATCGCGAAAAGCGAACAGGAGATAGGCAAGGCTACAG
CCAAATACTTCTTTTATTCTAACATTATGAATTTCTTTAAGACGGAAATC
ACTCTGGCAAACGGAGAGATACGCAAACGACCTTTAATTGAAACCAATGG
GGAGACAGGTGAAATCGTATGGGATAAGGGCCGGGACTTCGCGACGGTGA
GAAAAGTTTTGTCCATGCCCCAAGTCAACATAGTAAAGAAAACTGAGGTC
CAGACCGGAGGGTTTTCAAAGGAATCGATTCTTCCAAAAAGGAATAGTGA
TAAGCTCATCGCTCGTAAAAAGGACTGGGACCCGAAAAAGTACGGTGGCT
TCGATAGCCCTACAGTTGCCTATTCTGTCCTAGTAGTGGCAAAAGTTGAG
AAGGGAAAATCCAAGAAACTGAAGTCAGTCAAAGAATTATTGGGGATAAC
GATTATGGAGCGCTCGTCTTTTGAAAAGAACCCCATCGACTTCCTTGAGG
```

```
CGAAAGGTTACAAGGAAGTAAAAAAGGATCTCATAATTAAACTACCAAAG
TATAGTCTGTTTGAGTTAGAAAATGGCCGAAAACGGATGTTGGCTAGCGC
CGGAGAGCTTCAAAAGGGGAACGAACTCGCACTACCGTCTAAATACGTGA
ATTTCCTGTATTTAGCGTCCCATTACGAGAAGTTGAAAGGTTCACCTGAA
GATAACGAACAGAAGCAACTTTTTGTTGAGCAGCACAAACATTATCTCGA
CGAAATCATAGAGCAAATTTCGGAATTCAGTAAGAGAGTCATCCTAGCTG
ATGCCAATCTGGACAAAGTATTAAGCGCATACAACAAGCACAGGGATAAA
CCCATACGTGAGCAGGCGGAAAATATTATCCATTTGTTTTACTCTTACCA
CCTCGGCGCTCCAGCCGCATTCAAGTATTTTGACACAACGATAGATCGCA
AACGATACACTTCTACCAAGGAGGTGCTAGACGCGACACTGATTCACCAA
TCCATCACGGGATTATATGAAACTCGGATAGATTTGTCACAGCTTGGGGG
TGACGGATCCCCCAAGAAGAAGAGGAAAGTCTCGAGCGACTACAAAGACC
ATGACGGTGATTATAAAGATCATGACATCGATTACAAGGATGACGATGAC
AAGGCTGCAGGA
```

(SEQ ID NO: 4)
MDKK<u>YSIGLAIGTNSVGWAVITDEYKVPSKKFKVLGNTDRHSIKKNLIGA
LLFDSGET</u>AEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQG<u>DSLHEHIANLAGSPAIKKGILQTVKVVDELVKV
MGRHKPENIVIEMAR</u>ENQTTQKGQ<u>KNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERG</u>G<u>LSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QT</u>GGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD (single underline: HNH domain; double underline: RuvC domain)

In some embodiments, wild type Cas9 corresponds to Cas9 from *Streptococcus pyogenes* (NCBI Reference Sequence: NC_002737.2, SEQ ID NO: 5 (nucleotide); and Uniport Reference Sequence: Q99ZW2, SEQ ID NO: 6 (amino acid).

(SEQ ID NO: 5)
ATGGATAAGAAATACTCAATAGGCTTAGATATCGGCACAAATAGCGTCGG

ATGGGCGGTGATCACTGATGAATATAAGGTTCCGTCTAAAAAGTTCAAGG

TTCTGGGAAATACAGACCGCCACAGTATCAAAAAAATCTTATAGGGGCT

CTTTTATTTGACAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAAATTGGTAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAACCTACAATCAATTATTTGAAGAAAACCCT

ATTAACGCAAGTGGAGTAGATGCTAAAGCGATTCTTTCTGCACGATTGAG

TAAATCAAGACGATTAGAAAATCTCATTGCTCAGCTCCCCGGTGAGAAGA

AAAATGGCTTATTTGGGAATCTCATTGCTTTGTCATTGGGTTTGACCCCT

AATTTTAAATCAAATTTTGATTTGGCAGAAGATGCTAAATTACAGCTTTC

AAAAGATACTTACGATGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATACTGAAATAACTAAGGCTCCCCT

ATCAGCTTCAATGATTAAACGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGGAGC

TAGCCAAGAAGAATTTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAAGAAGATTGAAAAAATCTTGACTTTTCGAATTCCTTAT

TATGTTGGTCCATTGGCGCGTGGCAATAGTCGTTTTGCATGGATGACTCG

GAAGTCTGAAGAAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAAGTACTACCAAAACATAGTTTGCTTTATGAGTA

TTTTACGGTTTATAACGAATTGACAAAGGTCAAATATGTTACTGAAGGAA

TGCGAAAACCAGCATTTCTTTCAGGTGAACAGAAGAAAGCCATTGTTGAT

TTACTCTTCAAAACAAATCGAAAAGTAACCGTTAAGCAATTAAAAGAAGA

TTATTTCAAAAAAATAGAATGTTTTGATAGTGTTGAAATTTCAGGAGTTG

AAGATAGATTTAATGCTTCATTAGGTACCTACCATGATTTGCTAAAAATT

ATTAAAGATAAAGATTTTTTGGATAATGAAGAAATGAAGATATCTTAGA

GGATATTGTTTTAACATTGACCTTATTTGAAGATAGGGAGATGATTGAGG

AAAGACTTAAAACATATGCTCACCTCTTTGATGATAAGGTGATGAAACAG

CTTAAACGTCGCCGTTATACTGGTTGGGGACGTTTGTCTCGAAAATTGAT

TAATGGTATTAGGGATAAGCAATCTGGCAAAACAATATTAGATTTTTTGA

AATCAGATGGTTTTGCCAATCGCAATTTTATGCAGCTGATCCATGATGAT

AGTTTGACATTTAAAGAAGACATTCAAAAAGCACAAGTGTCTGGACAAGG

CGATAGTTTACATGAACATATTGCAAATTTAGCTGGTAGCCCTGCTATTA

AAAAAGGTATTTTACAGACTGTAAAAGTTGTTGATGAATTGGTCAAAGTA

ATGGGGCGGCATAAGCCAGAAAATATCGTTATTGAAATGGCACGTGAAAA

TCAGACAACTCAAAAGGGCCAGAAAAATTCGCGAGAGCGTATGAAACGAA

TCGAAGAAGGTATCAAAGAATTAGGAAGTCAGATTCTTAAAGAGCATCCT

GTTGAAAATACTCAATTGCAAATGAAAAGCTCTATCTCTATTATCTCCA

AAATGGAAGAGACATGTATGTGGACCAAGAATTAGATATTAATCGTTTAA

GTGATTATGATGTCGATCACATTGTTCCACAAAGTTTCCTTAAAGACGAT

TCAATAGACAATAAGGTCTTAACGCGTTCTGATAAAAATCGTGGTAAATC

GGATAACGTTCCAAGTGAAGAAGTAGTCAAAAAGATGAAAAACTATTGGA

GACAACTTCTAAACGCCAAGTTAATCACTCAACGTAAGTTTGATAATTTA

ACGAAAGCTGAACGTGGAGGTTTGAGTGAACTTGATAAAGCTGGTTTTAT

CAAACGCCAATTGGTTGAAACTCGCCAAATCACTAAGCATGTGGCACAAA

TTTTGGATAGTCGCATGAATACTAAATACGATGAAAATGATAAACTTATT

CGAGAGGTTAAAGTGATTACCTTAAAATCTAAATTAGTTTCTGACTTCCG

AAAAGATTTCCAATTCTATAAAGTACGTGAGATTAACAATTACCATCATG

CCCATGATGCGTATCTAAATGCCGTCGTTGGAACTGCTTTGATTAAGAAA

TATCCAAAACTTGAATCGGAGTTTGTCTATGGTGATTATAAAGTTTATGA

TGTTCGTAAAATGATTGCTAAGTCTGAGCAAGAAATAGGCAAAGCAACCG

CAAAATATTTCTTTTACTCTAATATCATGAACTTCTTCAAAACAGAAATT

ACACTTGCAAATGGAGAGATTCGCAAACGCCCTCTAATCGAAACTAATGG

GGAAACTGGAGAAATTGTCTGGGATAAAGGGCGAGATTTGCCACAGTGC

GCAAAGTATTGTCCATGCCCCAAGTCAATATTGTCAAGAAAACAGAAGTA

CAGACAGGCGGATTCTCCAAGGAGTCAATTTTACCAAAAAGAAATTCGGA

CAAGCTTATTGCTCGTAAAAAAGACTGGGATCCAAAAAAATATGGTGGTT

TTGATAGTCCAACGGTAGCTTATTCAGTCCTAGTGGTTGCTAAGGTGGAA

AAAGGGAAATCGAAGAAGTTAAAATCCGTTAAAGAGTTACTAGGGATCAC

AATTATGGAAAGAAGTTCCTTTGAAAAAAATCCGATTGACTTTTTAGAAG

CTAAAGGATATAAGGAAGTTAAAAAAGACTTAATCATTAAACTACCTAAA

```
-continued
TATAGTCTTTTTGAGTTAGAAAACGGTCGTAAACGGATGCTGGCTAGTGC

CGGAGAATTACAAAAAGGAAATGAGCTGGCTCTGCCAAGCAAATATGTGA

ATTTTTTATATTTAGCTAGTCATTATGAAAAGTTGAAGGGTAGTCCAGAA

GATAACGAACAAAAACAATTGTTTGTGGAGCAGCATAAGCATTATTTAGA

TGAGATTATTGAGCAAATCAGTGAATTTTCTAAGCGTGTTATTTTAGCAG

ATGCCAATTTAGATAAAGTTCTTAGTGCATATAACAAACATAGAGACAAA

CCAATACGTGAACAAGCAGAAAATATTATTCATTTATTTACGTTGACGAA

TCTTGGAGCTCCCGCTGCTTTTAAATATTTTGATACAACAATTGATCGTA

AACGATATACGTCTACAAAAGAAGTTTTAGATGCCACTCTTATCCATCAA

TCCATCACTGGTCTTTATGAAACACGCATTGATTTGAGTCAGCTAGGAGG

TGACTGA
```

```
                                  (SEQ ID NO: 6)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
```

(single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any of the organisms listed in Example 5.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and/or H840A mutation.

```
dCas9 (D10A and H840A):
                                  (SEQ ID NO: 7)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKE

PVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP
```

```
KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD (single underline: HNH domain;

(double underline: RuvC domain).
```

In some embodiments, the Cas9 domain comprises a D10A mutation, while the residue at position 840 remains a histidine in the amino acid sequence provided in SEQ ID NO: 6, or at corresponding positions in any of the amino acid sequences provided in another Cas9 domain, such as any of the Cas9 proteins provided herein. Without wishing to be bound by any particular theory, the presence of the catalytic residue H840 restores the activity of the Cas9 to cleave the non-edited (e.g., non-deaminated) strand containing a G opposite the targeted C. Restoration of H840 (e.g., from A840) does not result in the cleavage of the target strand containing the C. Such Cas9 variants are able to generate a single-strand DNA break (nick) at a specific location based on the gRNA-defined target sequence, leading to repair of the non-edited strand, ultimately resulting in a G to A change on the non-edited strand. A schematic representation of this process is shown in FIG. 108. Briefly, the C of a C-G basepair can be deaminated to a U by a deaminase, e.g., an APOBEC deamonase. Nicking the non-edited strand, having the G, facilitates removal of the G via mismatch repair mechanisms. UGI inhibits UDG, which prevents removal of the U.

In other embodiments, dCas9 variants having mutations other than D10A and H840A are provided, which, e.g., result in nuclease inactivated Cas9 (dCas9). Such mutations, by way of example, include other amino acid substitutions at D10 and H820, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 6) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 6. In some embodiments, variants of dCas9 (e.g., variants of SEQ ID NO: 6) are provided having amino acid sequences which are shorter, or longer than SEQ ID NO: 6, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all. Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* I (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytidine deaminase domain, catalyzing the hydrolytic deamination of cytosine to uracil. In some embodiments, the deaminase or deaminase domain is a naturally-occurring deaminase from an organism, such as a human, chimpanzee, gorilla, monkey, cow, dog, rat, or mouse. In some embodiments, the deaminase or deaminase domain is a variant of a naturally-occurring deaminase from an organism, that does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. In some embodiments, an effective amount of a fusion protein provided herein, e.g., of a fusion protein comprising a nuclease-inactive Cas9 domain and a nucleic acid editing domain (e.g., a deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nuclease, a deaminase, a recombinase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The term "linker," as used herein, refers to a chemical group or a molecule linking two molecules or moieties, e.g., two domains of a fusion protein, such as, for example, a nuclease-inactive Cas9 domain and a nucleic acid editing domain (e.g., a deaminase domain). A linker may be, for example, an amino acid sequence, a peptide, or a polymer of any length and composition. In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 1-100 amino acids in length, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "nucleic acid editing domain," as used herein refers to a protein or enzyme capable of making one or more modifications (e.g., deamination of a cytidine residue) to a nucleic acid (e.g., DNA or RNA). Exemplary nucleic acid editing domains include, but are not limited to a deaminase, a nuclease, a nickase, a recombinase, a methyltransferase, a methylase, an acetylase, an acetyltransferase, a transcriptional activator, or a transcriptional repressor domain. In some embodiments the nucleic acid editing domain is a deaminase (e.g., a cytidine deaminase, such as an APOBEC or an AID deaminase).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4*th* ed., Cold Spring Harbor Laboratory Press, Cold Spring Harbor, N.Y. (2012)), the entire contents of which are incorporated herein by reference.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is deaminated by a deaminase or a fusion protein comprising a deaminase, (e.g., a dCas9-deaminase fusion protein provided herein).

The terms "treatment," "treat," and "treating" refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

The term "pharmaceutical composition," as used herein, refers to a composition that can be administrated to a subject in the context of treatment of a disease or disorder. In some embodiments, a pharmaceutical composition comprises an active ingredient, e.g., a nuclease or a nucleic acid encoding a nuclease, and a pharmaceutically acceptable excipient.

The term "base editor (BE)," or "nucleobase editor (NBE)," as used herein, refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an cytosine (C) in DNA. In some embodiments, the base editor is a fusion protein comprising a nucleic acid programmable DNA binding protein (napDNAbp) fused to a cytidine deaminase domain. In some embodiments, the base editor comprises a Cas9 (e.g., dCas9 and nCas9), CasX, CasY, Cpf1, C2c1, C2c2, C2c3, or Argonaute protein fused to a cytidine deaminase. In some embodiments, the base editor comprises a Cas9 nickase (nCas9) fused to an cytidine deaminase. In some embodiments, the base editor comprises a nuclease-inactive Cas9 (dCas9) fused to a cytidine deaminase. In some embodiments, the base editor is fused to an inhibitor of base excision repair, for example, a UGI domain. In some embodiments, the base editor comprises a CasX protein fused to a cytidine deaminase. In some embodiments, the base editor comprises a CasY protein fused to a cytidine deaminase. In some embodiments, the base editor comprises a Cpf1 protein fused to a cytidine deaminase. In some embodiments, the base editor comprises a C2c1 protein fused to a cytidine deaminase. In some embodiments, the base editor comprises a C2c2 protein fused to a cytidine deaminase. In some embodiments, the base editor comprises a C2c3 protein fused to a cytidine deaminase. In some embodiments, the base editor comprises an Argonaute protein fused to a cytidine deaminase.

The term "uracil glycosylase inhibitor" or "UGI," as used herein, refers to a protein that is capable of inhibiting a uracil-DNA glycosylase base-excision repair enzyme.

The term "Cas9 nickase," as used herein, refers to a Cas9 protein that is capable of cleaving only one strand of a duplexed nucleic acid molecule (e.g., a duplexed DNA molecule). In some embodiments, a Cas9 nickase comprises a D10A mutation and has a histidine at position H840 of SEQ ID NO: 6, or a corresponding mutation in another Cas9 domain, such as any of the Cas9 proteins provided herein. For example, a Cas9 nickase may comprise the amino acid sequence as set forth in SEQ ID NO: 8. Such a Cas9 nickase has an active HNH nuclease domain and is able to cleave the non-targeted strand of DNA, i.e., the strand bound by the gRNA. Further, such a Cas9 nickase has an inactive RuvC nuclease domain and is not able to cleave the targeted strand of the DNA, i.e., the strand where base editing is desired.

Exemplary Cas9 nickase (Cloning vector pPlatTET-gRNA2; Accession No. BAV54124).

```
                                             (SEQ ID NO: 8)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK
```

-continued

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD

DETAILED DESCRIPTION OF CERTAIN EMBODIMENTS OF THE INVENTION

Some aspects of this disclosure provide fusion proteins that comprise a domain capable of binding to a nucleotide sequence (e.g., a Cas9, or a Cpf1 protein) and an enzyme domain, for example, a DNA-editing domain, such as, e.g., a deaminase domain. The deamination of a nucleobase by a deaminase can lead to a point mutation at the respective residue, which is referred to herein as nucleic acid editing. Fusion proteins comprising a Cas9 variant or domain and a DNA editing domain can thus be used for the targeted editing of nucleic acid sequences. Such fusion proteins are useful for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations, e.g., the correction of genetic defects or the introduction of deactivating mutations in disease-associated genes in a subject. Typically, the Cas9 domain of the fusion proteins described herein does not have any nuclease activity but instead is a Cas9 fragment or a dCas9 protein or domain. Other aspects of the invention provide fusion proteins that comprise (i) a domain capable of binding to a nucleic acid sequence (e.g., a Cas9, or a Cpf1 protein); (ii) an enzyme domain, for example, a DNA-editing domain (e.g., a deaminase domain); and (iii) one or more uracil glycosylase inhibitor (UGI) domains. The presence of at least one UGI domain increases base editing efficiency compared to fusion proteins without a UGI domain. A fusion protein comprising two UGI domains further increases base editing efficiency and product purity compared to fusion proteins with one UGI domain or without a UGI domain. Methods for the use of Cas9 fusion proteins as described herein are also provided.

Nucleic Acid Programmable DNA Binding Proteins

Some aspects of the disclosure provide nucleic acid programmable DNA binding proteins, which may be used to guide a protein, such as a base editor, to a specific nucleic acid (e.g., DNA or RNA) sequence. It should be appreciated that any of the fusion proteins (e.g., base editors) provided herein may include any nucleic acid programmable DNA binding protein (napDNAbp). For example, any of the fusion proteins described herein that include a Cas9 domain, can use another napDNAbp, such as CasX, CasY, Cpf1, C2c1, C2c2, C2c3, and Argonaute, in place of the Cas9 domain. Nucleic acid programmable DNA binding proteins include, without limitation, Cas9 (e.g., dCas9 and nCas9), CasX, CasY, Cpf1, C2c1, C2c2, C2C3, and Argonaute. One example of a nucleic acid programmable DNA-binding protein that has a different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example, Yamano et al., "Crystal structure of Cpf1 in complex with guide RNA and target DNA." *Cell* (165) 2016, p. 949-962; the entire contents of which are incorporated herein by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alpha-helical recognition lobe of Cas9. It was shown in Zetsche et al., *Cell*, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 15) inactivate Cpf1 nuclease activity. In some embodiments, the dead Cpf1 (dCpf1) comprises mutations corresponding to D917A, E1006A, D1255A, D917A/E1006A, D917A/D1255A, E1006A/D1255A, or D917A/E1006A/D1255A in SEQ ID NO: 9. It is to be understood that any mutations, e.g., substitution mutations, deletions, or insertions, that inactivate the RuvC domain of Cpf1, may be used in accordance with the present disclosure.

In some embodiments, the nucleic acid programmable DNA binding protein (napDNAbp) of any of the fusion proteins provided herein is a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 9-24. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 9-16, and comprises mutations corresponding to D917A, E1006A, D1255A, D917A/E1006A, D917A/D1255A, E1006A/D1255A, or D917A/E1006A/D1255A in SEQ ID NO: 9. In some embodiments, the dCpf1 protein comprises an amino acid sequence of any one SEQ ID NOs: 9-16. It should be appreciated that Cpf1 from other species may also be used in accordance with the present disclosure. Wild type *Franciscella novicida* Cpf1 (SEQ ID NO: 9) (D917, E1006, and D1255 are bolded and underlined)

(SEQ ID NO: 9)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

*Francisella novicida* Cpf1 D917A (SEQ ID NO: 10) (A917, E1006, and D1255 are bolded and underlined)

(SEQ ID NO: 10)

MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

-continued

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIARGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

*Francisella novicida* Cpf1 E1006A (SEQ ID NO: 11) (D917, A1006, and D1255 are bolded and underlined)

(SEQ ID NO: 11)

MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

-continued

```
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIDRGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDADANGAYHIGLKGLMLLGRIKNNQEGKKLNLVIKNEEYFEFVQNRNN
```

*Francisella novicida* Cpf1 D1255A (SEQ ID NO: 12) (D917, E1006, and A1255 are bolded and underlined)

```
                                          (SEQ ID NO: 12)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIDRGERHLAYYTLVDGKGNIIKQDTFNIIGNDRMK
TNYHDKLAAIEKDRDSARKDWKKINNIKEMKEGYLSQVVHEIAKLVIEYN
AIVVFEDLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN
```

*Francisella novicida* Cpf1 D917A/E1006A (SEQ ID NO: 13) (A917, A1006, and D1255 are bolded and underlined)

```
                                          (SEQ ID NO: 13)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIARGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDADANGAYHIGLKGLMLLGRIKNNQEGKKLNLVIKNEEYFEFVQNRNN
```

*Francisella novicida* Cpf1 D917A/D1255A (SEQ ID NO: 14) (A917, E1006, and A1255 are bolded and underlined)

```
                                          (SEQ ID NO: 14)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
```

```
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIARGERHLAYYTLVDGKGNIIKQDTFNIIGNDRMK
TNYHDKLAAIEKDRDSARKDWKKINNIKEMKEGYLSQVVHEIAKLVIEYN
AIVVFEDLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN
```

*Francisella novicida* Cpf1 E1006A/D1255A (SEQ ID NO: 15) (D917, A1006, and A1255 are bolded and underlined)

```
                                        (SEQ ID NO: 15)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIDRGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN
```

*Francisella novicida* Cpf1 D917A/E1006A/D1255A (SEQ ID NO: 16) (A917, A1006, and A1255 are bolded and underlined)

```
                                        (SEQ ID NO: 16)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIARGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN
```

In some embodiments, the nucleic acid programmable DNA binding protein is a Cpf1 protein from an *Acidaminococcus* species (AsCpf1). Cpf1 proteins form *Acidaminococcus* species have been described previously and would be apparent to the skilled artisan. Exemplary *Acidaminococcus* Cpf1 proteins (AsCpf1) include, without limitation, any of the AsCpf1 proteins provided herein.

Wild-type AsCpf1—Residue R912 is indicated in bold underlining and residues 661-667 are indicated in italics and underlining.

(SEQ ID NO: 17)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYA*KKTGDQK*GYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGERNLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRN

AsCpf1(R912A)—Residue A912 is indicated in bold underlining and residues 661-667 are indicated in italics and underlining.

(SEQ ID NO: 19)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYA*KKTGDQK*GYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGEANLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRN

In some embodiments, the nucleic acid programmable DNA binding protein is a Cpf1 protein from a Lachnospiraceae species (LbCpf1). Cpf1 proteins form Lachnospiraceae species have been described previously have been described previously and would be apparent to the skilled artisan. Exemplary Lachnospiraceae Cpf1 proteins (LbCpf1) include, without limitation, any of the LbCpf1 proteins provided herein.

In some embodiments, the LbCpf1 is a nickase. In some embodiments, the LbCpf1 nickase comprises an R836X mutant relative to SEQ ID NO: 18, wherein X is any amino acid except for R. In some embodiments, the LbCpf1 nickase comprises R836A mutant relative to SEQ ID NO: 18. In some embodiments, the LbCpf1 is a nuclease inactive LbCpf1 (dLbCpf1). In some embodiments, the dLbCpf1 comprises a D832X mutant relative to SEQ ID NO: 18, wherein X is any amino acid except for D. In some embodiments, the dLbCpf1 comprises a D832A mutant relative to SEQ ID NO: 18. Additional dCpf1 proteins have been described in the art, for example, in Li et al. "Base editing with a Cpf1-cytidine deaminase fusion" *Nature Biotechnology*; March 2018 DOI: 10.1038/nbt.4102; the entire contents of which are incorporated herein by reference. In some embodiments, the dCpf1 comprises 1, 2, or 3 of the point mutations D832A, E1006A, D1125A of the Cpf1 described in Li et al.

Wild-type LbCpf1—Residues R836 and R1138 is indicated in bold underlining.

(SEQ ID NO: 18)
MSKLEKFTNCYSLSKTLRFKAIPVGKTQENIDNKRLLVEDEKRAEDYKGV

KKLLDRYYLSFINDVLHSIKLKNLNNYISLFRKKTRTEKENKELENLEIN

LRKEIAKAFKGNEGYKSLFKKDIIETILPEFLDDKDEIALVNSFNGFTTA

FTGFFDNRENMFSEEAKSTSIAFRCINENLTRYISNMDIFEKVDAIFDKH

-continued

EVQEIKEKILNSDYDVEDFFEGEFFNFVLTQEGIDVYNAIIGGFVTESGE

KIKGLNEYINLYNQKTKQKLPKFKPLYKQVLSDRESLSFYGEGYTSDEEV

LEVFRNTLNKNSEIFSSIKKLEKLFKNFDEYSSAGIFVKNGPAISTISKD

IFGEWNVIRDKWNAEYDDIHLKKKAVVTEKYEDDRRKSFKKIGSFSLEQL

QEYADADLSVVEKLKEIIQKVDEIYKVYGSSEKLFDADFVLEKSLKKND

AVVAIMKDLLDSVKSFENYIKAFFGEGKETNRDESFYGDFVLAYDILLKV

DHIYDAIRNYVTQKPYSKDKFKLYFQNPQFMGGWDKDKETDYRATILRYG

SKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWS

NAYDFNFSETEKYKDIAGFYREVEEQGYKVSFESASKKEVDKLVEEGKLY

MFQIYNKDFSDKSHGTPNLHTMYFKLLFDENNHGQIRLSGGAELFMRRAS

LKKEELVVHPANSPIANKNPDNPKKTTTLSYDVYKDKRFSEDQYELHIPI

AINKCPKNIFKINTEVRVLLKHDDNPYVIGIDRGERNLLYIVVVDGKGNI

VEQYSLNEIINNFNGIRIKTDYHSLLDKKEKERFEARQNWTSIENIKELK

AGYISQVVHKICELVEKYDAVIALEDLNSGFKNSRVKVEKQVYQKFEKML

IDKLNYMVDKKSNPCATGGALKGYQITNKFESFKSMSTQNGFIFYIPAWL

TSKIDPSTGFVNLLKTKYTSIADSKKFISSFDRIMYVPEEDLFEFALDYK

NFSRTDADYIKKWKLYSYGNRIRIFRNPKKNNVFDWEEVCLTSAYKELFN

KYGINYQQGDIRALLCEQSDKAFYSSFMALMSLMLQMRNSITGRTDVDFL

ISPVKNSDGIFYDSRNYEAQENAILPKNADANGAYNIARKVLWAIGQFKK

AEDEKLDKVKIAISNKEWLEYAQTSVKH

LbCpf1 (R836A)—Residue A836 is indicated in bold underlining.

(SEQ ID NO: 20)
MSKLEKFTNCYSLSKTLRFKAIPVGKTQENIDNKRLLVEDEKRAEDYKGV

KKLLDRYYLSFINDVLHSIKLKNLNNYISLFRKKTRTEKENKELENLEIN

LRKEIAKAFKGNEGYKSLFKKDIIETILPEFLDDKDEIALVNSFNGFTTA

FTGFFDNRENMFSEEAKSTSIAFRCINENLTRYISNMDIFEKVDAIFDKH

EVQEIKEKILNSDYDVEDFFEGEFFNFVLTQEGIDVYNAIIGGFVTESGE

KIKGLNEYINLYNQKTKQKLPKFKPLYKQVLSDRESLSFYGEGYTSDEEV

LEVFRNTLNKNSEIFSSIKKLEKLFKNFDEYSSAGIFVKNGPAISTISKD

IFGEWNVIRDKWNAEYDDIHLKKKAVVTEKYEDDRRKSFKKIGSFSLEQL

QEYADADLSVVEKLKEIIQKVDEIYKVYGSSEKLFDADFVLEKSLKKND

AVVAIMKDLLDSVKSFENYIKAFFGEGKETNRDESFYGDFVLAYDILLKV

DHIYDAIRNYVTQKPYSKDKFKLYFQNPQFMGGWDKDKETDYRATILRYG

SKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWS

NAYDFNFSETEKYKDIAGFYREVEEQGYKVSFESASKKEVDKLVEEGKLY

MFQIYNKDFSDKSHGTPNLHTMYFKLLFDENNHGQIRLSGGAELFMRRAS

LKKEELVVHPANSPIANKNPDNPKKTTTLSYDVYKDKRFSEDQYELHIPI

AINKCPKNIFKINTEVRVLLKHDDNPYVIGIDRGEANLLYIVVVDGKGNI

VEQYSLNEIINNFNGIRIKTDYHSLLDKKEKERFEARQNWTSIENIKELK

AGYISQVVHKICELVEKYDAVIALEDLNSGFKNSRVKVEKQVYQKFEKML

IDKLNYMVDKKSNPCATGGALKGYQITNKFESFKSMSTQNGFIFYIPAWL

TSKIDPSTGFVNLLKTKYTSIADSKKFISSFDRIMYVPEEDLFEFALDYK

NFSRTDADYIKKWKLYSYGNRIRIFRNPKKNNVFDWEEVCLTSAYKELFN

KYGINYQQGDIRALLCEQSDKAFYSSFMALMSLMLQMRNSITGRTDVDFL

ISPVKNSDGIFYDSRNYEAQENAILPKNADANGAYNIARKVLWAIGQFKK

AEDEKLDKVKIAISNKEWLEYAQTSVKH

LbCpf1 (R1138A)—Residue A1138 is indicated in bold underlining.

(SEQ ID NO: 21)
MSKLEKFTNCYSLSKTLRFKAIPVGKTQENIDNKRLLVEDEKRAEDYKGV

KKLLDRYYLSFINDVLHSIKLKNLNNYISLFRKKTRTEKENKELENLEIN

LRKEIAKAFKGNEGYKSLFKKDIIETILPEFLDDKDEIALVNSFNGFTTA

FTGFFDNRENMFSEEAKSTSIAFRCINENLTRYISNMDIFEKVDAIFDKH

EVQEIKEKILNSDYDVEDFFEGEFFNFVLTQEGIDVYNAIIGGFVTESGE

KIKGLNEYINLYNQKTKQKLPKFKPLYKQVLSDRESLSFYGEGYTSDEEV

LEVFRNTLNKNSEIFSSIKKLEKLFKNFDEYSSAGIFVKNGPAISTISKD

IFGEWNVIRDKWNAEYDDIHLKKKAVVTEKYEDDRRKSFKKIGSFSLEQL

QEYADADLSVVEKLKEIIQKVDEIYKVYGSSEKLFDADFVLEKSLKKND

AVVAIMKDLLDSVKSFENYIKAFFGEGKETNRDESFYGDFVLAYDILLKV

DHIYDAIRNYVTQKPYSKDKFKLYFQNPQFMGGWDKDKETDYRATILRYG

SKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWS

NAYDFNFSETEKYKDIAGFYREVEEQGYKVSFESASKKEVDKLVEEGKLY

MFQIYNKDFSDKSHGTPNLHTMYFKLLFDENNHGQIRLSGGAELFMRRAS

LKKEELVVHPANSPIANKNPDNPKKTTTLSYDVYKDKRFSEDQYELHIPI

AINKCPKNIFKINTEVRVLLKHDDNPYVIGIDRGERNLLYIVVVDGKGNI

VEQYSLNEIINNFNGIRIKTDYHSLLDKKEKERFEARQNWTSIENIKELK

AGYISQVVHKICELVEKYDAVIALEDLNSGFKNSRVKVEKQVYQKFEKML

IDKLNYMVDKKSNPCATGGALKGYQITNKFESFKSMSTQNGFIFYIPAWL

TSKIDPSTGFVNLLKTKYTSIADSKKFISSFDRIMYVPEEDLFEFALDYK

NFSRTDADYIKKWKLYSYGNRIRIFRNPKKNNVFDWEEVCLTSAYKELFN

KYGINYQQGDIRALLCEQSDKAFYSSFMALMSLMLQMANSITGRTDVDFL

ISPVKNSDGIFYDSRNYEAQENAILPKNADANGAYNIARKVLWAIGQFKK

AEDEKLDKVKIAISNKEWLEYAQTSVKH

In some embodiments, the Cpf1 protein is a crippled Cpf1 protein. As used herein a "crippled Cpf1" protein is a Cpf1 protein having diminished nuclease activity as compared to a wild-type Cpf1 protein. In some embodiments, the crippled Cpf1 protein preferentially cuts the target strand more efficiently than the non-target strand. For example, the Cpf1 protein preferentially cuts the strand of a duplexed nucleic acid molecule in which a nucleotide to be edited resides. In some embodiments, the crippled Cpf1 protein preferentially cuts the non-target strand more efficiently than the target strand. For example, the Cpf1 protein preferentially cuts the strand of a duplexed nucleic acid molecule in which a nucleotide to be edited does not reside. In some embodiments, the crippled Cpf1 protein preferentially cuts the target strand at least 5% more efficiently than it cuts the non-target strand. In some embodiments, the crippled Cpf1 protein preferentially cuts the target strand at least 5%, 10%, 15%, 20%, 25%, 30%, 35%, 40%, 50%, 60%, 70%, 80%, 90%, or at least 100% more efficiently than it cuts the non-target strand.

In some embodiments, a crippled Cpf1 protein is a non-naturally occurring Cpf1 protein. In some embodiments, the crippled Cpf1 protein comprises one or more mutations relative to a wild-type Cpf1 protein. In some embodiments, the crippled Cpf1 protein comprises 1, 2, 3, 4, 5, 6, 7, 8, 9, 10, 11, 12, 13, 14, 15, 16, 17, 18, 19, or 20 mutations relative to a wild-type Cpf1 protein. In some embodiments, the crippled Cpf1 protein comprises an R836A mutation as set forth in SEQ ID NO: 18, or in a corresponding amino acid in another Cpf1 protein. It should be appreciated that a Cpf1 comprising a homologous residue (e.g., a corresponding amino acid) to R836A of SEQ ID NO: 18 could also be mutated to achieve similar results. In some embodiments, the crippled Cpf1 protein comprises a R1138A mutation as set forth in SEQ ID NO: 18, or in a corresponding amino acid in another Cpf1 protein. In some embodiments, the crippled Cpf1 protein comprises an R912A mutation mutation as set forth in SEQ ID NO: 17, or in a corresponding amino acid in another Cpf1 protein. Without wishing to be bound by any particular theory, residue R836 of SEQ ID NO: 18 (LbCpf1) and residue R912 of SEQ ID NO: 17 (AsCpf1) are examples of corresponding (e.g., homologous) residues. For example, a portion of the alignment between SEQ ID NO: 17 and 18 shows that R912 and R836 are corresponding residues.

Q666 and K667 deletion in SEQ ID NO: 17, or corresponding deletions in another Cpf1 protein.

AsCpf1 (Deleted T663 and D665)

```
AsCpf1 (deleted T663 and D665)
                                          (SEQ ID NO: 22)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKGQKGYREALCKWIDFTRDFLSKYTKTTSIDLSSLRPSS

QYKDLGEYYAELNPLLYHISFQRIAEKEIMDAVETGKLYLFQIYNKDFAK

GHHGKPNLHTLYWTGLFSPENLAKTSIKLNGQAELFYRPKSRMKRMAHRL

GEKMLNKKLKDQKTPIPDTLYQELYDYVNHRLSHDLSDEARALLPNVITK

EVSHEIIKDRRFTSDKFFFHVPITLNYQAANSPSKFNQRVNAYLKEHPET

PIIGIDRGERNLIYITVIDSTGKILEQRSLNTIQQFDYQKKLDNREKERV
```

```
AsCpf1 YQAANSPSKFNQRVNAYLKEHPETPIIGIDRGERNLIYITVIDSTGKILEQRSLNTIQ--
LbCpf1 KCPKN-IFKINTEVRVLLKHDDNPYVIGIDRGERNLLYIVVVDGKGNIVEQYSLNEIINN
        *  *:* .*.. **.. :  :**********:**.*:*..*:*:** *** *
```

In some embodiments, any of the Cpf1 proteins provided herein comprises one or more amino acid deletions. In some embodiments, any of the Cpf1 proteins provided herein comprises 1, 2, 3, 4, 5, 6, 7, 8, 9, 10, 11, 12, 13, 14, 15, 16, 17, 18, 19, or 20 amino acid deletions. Without wishing to be bound by any particular theory, there is a helical region in Cpf1, which includes residues 661-667 of AsCpf1 (SEQ ID NO: 17), that may obstruct the function of a deaminase (e.g., APOBEC) that is fused to the Cpf1. This region comprises the amino acid sequence KKTGDQK. Accordingly, aspects of the disclosure provide Cpf1 proteins comprising mutations (e.g., deletions) that disrupt this helical region in Cpf1. In some embodiments, the Cpf1 protein comprises one or more deletions of the following residues in SEQ ID NO: 17, or one or more corresponding deletions in another Cpf1 protein: K661, K662, T663, G664, D665, Q666, and K667. In some embodiments, the Cpf1 protein comprises a T663 and a D665 deletion in SEQ ID NO: 17, or corresponding deletions in another Cpf1 protein. In some embodiments, the Cpf1 protein comprises a K662, T663, D665, and Q666 deletion in SEQ ID NO: 17, or corresponding deletions in another Cpf1 protein. In some embodiments, the Cpf1 protein comprises a K661, K662, T663, D665,

```
-continued
AARQAWSVVGTIKDLKQGYLSQVIHEIVDLMIHYQAVVVLENLNFGFKSK

RTGIAEKAVYQQFEKMLIDKLNCLVLKDYPAEKVGGVLNPYQLTDQFTSF

AKMGTQSGFLFYVPAPYTSKIDPLTGFVDPFVWKTIKNHESRKHFLEGFD

FLHYDVKTGDFILHFKMNRNLSFQRGLPGFMPAWDIVFEKNETQFDAKGT

PFIAGKRIVPVIENHRFTGRYRDLYPANELIALLEEKGIVFRDGSNILPK

LLENDDSHAIDTMVALIRSVLQMRNSNAATGEDYINSPVRDLNGVCFDSR

FQNPEWPMDADANGAYHIALKGQLLLNHLKESKDLKLQNGISNQDWLAYI

QELRN
```

AsCpf1 (Deleted K662, T663, D665, and Q666)

```
AsCpf1 (deleted K662, T663, D665, and Q666)
                                          (SEQ ID NO: 23)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT
```

-continued

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKGKGYREALCKWIDFTRDFLSKYTKTTSIDLSSLRPSSQY

KDLGEYYAELNPLLYHISFQRIAEKEIMDAVETGKLYLFQIYNKDFAKGH

HGKPNLHTLYWTGLFSPENLAKTSIKLNGQAELFYRPKSRMKRMAHRLGE

KMLNKKLKDQKTPIPDTLYQELYDYVNHRLSHDLSDEARALLPNVITKEV

SHEIIKDRRFTSDKFFFHVPITLNYQAANSPSKFNQRVNAYLKEHPETPI

IGIDRGERNLIYITVIDSTGKILEQRSLNTIQQFDYQKKLDNREKERVAA

RQAWSVVGTIKDLKQGYLSQVIHEIVDLMIHYQAVVVLENLNFGFKSKRT

GIAEKAVYQQFEKMLIDKLNCLVLKDYPAEKVGGVLNPYQLTDQFTSFAK

MGTQSGFLFYVPAPYTSKIDPLTGFVDPFVWKTIKNHESRKHFLEGFDFL

HYDVKTGDFILHFKMNRNLSFQRGLPGFMPAWDIVFEKNETQFDAKGTPF

IAGKRIVPVIENHRFTGRYRDLYPANELIALLEEKGIVFRDGSNILPKLL

ENDDSHAIDTMVALIRSVLQMRNSNAATGEDYINSPVRDLNGVCFDSRFQ

NPEWPMDADANGAYHIALKGQLLLNHLKESKDLKLQNGISNQDWLAYIQE

LRN

AsCpf1 (Deleted K661, K662, T663, D665, Q666, and K667)

AsCpf1 (deleted K661, K662, T663, D665, Q666, and K667)
(SEQ ID NO: 24)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAGGYREALCKWIDFTRDFLSKYTKTTSIDLSSLRPSSQYKD

LGEYYAELNPLLYHISFQRIAEKEIMDAVETGKLYLFQIYNKDFAKGHHG

KPNLHTLYWTGLFSPENLAKTSIKLNGQAELFYRPKSRMKRMAHRLGEKM

LNKKLKDQKTPIPDTLYQELYDYVNHRLSHDLSDEARALLPNVITKEVSH

EIIKDRRFTSDKFFFHVPITLNYQAANSPSKFNQRVNAYLKEHPETPIIG

IDRGERNLIYITVIDSTGKILEQRSLNTIQQFDYQKKLDNREKERVAARQ

AWSVVGTIKDLKQGYLSQVIHEIVDLMIHYQAVVVLENLNFGFKSKRTGI

AEKAVYQQFEKMLIDKLNCLVLKDYPAEKVGGVLNPYQLTDQFTSFAKMG

TQSGFLFYVPAPYTSKIDPLTGFVDPFVWKTIKNHESRKHFLEGFDFLHY

DVKTGDFILHFKMNRNLSFQRGLPGFMPAWDIVFEKNETQFDAKGTPFIA

GKRIVPVIENHRFTGRYRDLYPANELIALLEEKGIVFRDGSNILPKLLEN

DDSHAIDTMVALIRSVLQMRNSNAATGEDYINSPVRDLNGVCFDSRFQNP

EWPMDADANGAYHIALKGQLLLNHLKESKDLKLQNGISNQDWLAYIQELR

N

In some embodiments, the nucleic acid programmable DNA binding protein (napDNAbp) is a nucleic acid programmable DNA binding protein that does not require a canonical (NGG) PAM sequence in the target sequence. In some embodiments, the napDNAbp is an Argonaute protein. One example of such a nucleic acid programmable DNA binding protein is an Argonaute protein from *Natronobacterium gregoryi* (NgAgo). NgAgo is a ssDNA-guided endonuclease. NgAgo binds 5'-phosphorylated ssDNA of ~24 nucleotides (gDNA) in length to guide it to a target site and makes DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat. Biotechnol.*, 2016 July; 34(7):768-73. PubMed PMID: 27136078; Swarts et al., *Nature* 507(7491) (2014):258-61; and Swarts et al., *Nucleic Acids Res.* 43(10) (2015):5120-9, each of which is incorporated herein by reference. The sequence of *Natronobacterium gregoryi* Argonaute is provided in SEQ ID NO: 25.

In some embodiments, the napDNAbp is an Argonaute protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Argonaute protein. In some embodiments, the napDNAbp is a naturally-occurring Argonaute protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NO: 25. In some embodiments, the napDNAbp comprises an amino acid sequence of any one SEQ ID NO: 25.

Wild type *Natronobacterium gregoryi* Argonaute
(SEQ ID NO: 25)

MTVIDLDSTTTADELTSGHTYDISVTLTGVYDNTDEQHPRMSLAFEQDNG

ERRYITLWKNTTPKDVFTYDYATGSTYIFTNIDYEVKDGYENLTATYQTT

VENATAQEVGTTDEDETFAGGEPLDHHLDDALNETPDDAETESDSGHVMT

SFASRDQLPEWTLHTYTLTATDGAKTDTEYARRTLAYTVRQELYTDHDAA

PVATDGLMLLTPEPLGETPLDLDCGVRVEADETRTLDYTTAKDRLLAREL

VEEGLKRSLWDDYLVRGIDEVLSKEPVLTCDEFDLHERYDLSVEVGHSGR

AYLHINFRHRFVPKLTLADIDDDNIYPGLRVKTTYRPRRGHIVWGLRDEC

ATDSLNTLGNQSVVAYHRNNQTPINTDLLDAIEAADRRVVETRRQGHGDD

AVSFPQELLAVEPNTHQIKQFASDGFHQQARSKTRLSASRCSEKAQAFAE

RLDPVRLNGSTVEFSSEFFTGNNEQQLRLLYENGESVLTFRDGARGAHPD

ETFSKGIVNPPESFEVAVVLPEQQADTCKAQWDTMADLLNQAGAPPTRSE

TVQYDAFSSPESISLNVAGAIDPSEVDAAFVVLPPDQEGFADLASPTETY

DELKKALANMGIYSQMAYFDRFRDAKIFYTRNVALGLLAAAGGVAFTTEH

AMPGDADMFIGIDVSRSYPEDGASGQINIAATATAVYKDGTILGHSSTRP

QLGEKLQSTDVRDIMKNAILGYQQVTGESPTHIVIHRDGFMNEDLDPATE

FLNEQGVEYDIVEIRKQPQTRLLAVSDVQYDTPVKSIAAINQNEPRATVA

TFGAPEYLATRDGGGLPRPIQIERVAGETDIETLTRQVYLLSQSHIQVHN

STARLPITTAYADQASTHATKGYLVQTGAFESNVGFL

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol. Direct.* 2009 Aug. 25; 4:29. doi: 10.1186/1745-6150-4-29, is incorporated herein by reference. In some embodiments, the napDNAbp is a *Marinitoga piezophila* Argunaute (MpAgo) protein. The CRISPR-associated *Marinitoga piezophila* Argonaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other Argonaute proteins may be used in any of the fusion proteins (e.g., base editors) described herein, for example, to guide a deaminase (e.g., cytidine deaminase) to a target nucleic acid (e.g., ssRNA).

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3):385-397, the entire contents of which are herein incorporated by reference. Effectors of two of the systems, C2c1 and C2c3, contain RuvC-like endonuclease domains related to Cpf1. A third system, C2c2 contains an effector with two predicted HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programmed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector," *Science,* 2016 Aug. 5; 353(6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See, e.g., Liu et al., "C2c1-sgRNA Complex Structure Reveals RNA-Guided DNA Cleavage Mechanism", Mol. Cell, 2017 Jan. 19; 65(2):310-322, incorporated herein by reference. The crystal structure has also been reported for *Alicyclobacillus acidoterrestris* C2c1 bound to target DNAs as ternary complexes. See, e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein is a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring C2c1, C2c2, or C2c3 protein. In some embodiments, the napDNAbp is a naturally-occurring C2c1, C2c2, or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 26-28. In some embodiments, the napDNAbp comprises an amino acid sequence of any one SEQ ID NOs: 26-28. It should be appreciated that C2c1, C2c2, or C2c3 from other bacterial species may also be used in accordance with the present disclosure.

C2c1 (uniprot.org/uniprot/T0D7A2#)
sp|T0D7A2|C2C1_ALIAG CRISPR-associated endonuclease C2c1 OS=*Alicyclobacillus acidoterrestris* (strain ATCC 49025/DSM 3922/CIP 106132/NCIMB 13137/GD3B) GN=c2c1 PE=1 SV=1

(SEQ ID NO: 26)
MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR

MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPFSAEEGDFHQIHADLNAAQNLQQRLWSDFDISQIRLR

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI

C2c2 (uniprot.org/uniprot/P0DOC6)
>sp|P0DOC6|C2C2_LEPSD CRISPR-associated endoribonuclease C2c2 OS=*Leptotrichia shahii* (strain DSM 19757/CCUG 47503/CIP 107916/JCM 16776/LB37) GN=c2c2 PE=1 SV=1

(SEQ ID NO: 27)
MGNLFGHKRWYEVRDKKDFKIKRKVKVKRNYDGNKYILNINENNNKEKID

NNKFIRKYINYKKNDNILKEFTRKFHAGNILFKLKGKEGIIRIENNDDFL

ETEEVVLYIEAYGKSEKLKALGITKKKIIDEAIRQGITKDDKKIEIKRQE

NEEEIEIDIRDEYTNKTLNDCSIILRIIENDELETKKSIYEIFKNINMSL

YKIIEKIIENETEKVFENRYYEEHLREKLLKDDKIDVILTNFMEIREKIK

SNLEILGFVKFYLNVGGDKKKSKNKKMLVEKILNINVDLTVEDIADFVIK

ELEFWNITKRIEKVKKVNNEFLEKRRNRTYIKSYVLLDKHEKFKIERENK

KDKIVKFFVENIKNNSIKEKIEKILAEFKIDELIKKLEKELKKGNCDTEI

FGIFKKHYKVNFDSKKFSKKSDEEKELYKIIYRYLKGRIEKILVNEQKVR

LKKMEKIEIEKILNESILSEKILKRVKQYTLEHIMYLGKLRHNDIDMTTV

NTDDFSRLHAKEELDLELITFFASTNMELNKIFSRENINNDENIDFFGGD

REKNYVLDKKILNSKIKIIRDLDFIDNKNNITNNFIRKFTKIGTNERNRI

LHAISKERDLQGTQDDYNKVINIIQNLKISDEEVSKALNLDVVFKDKKNI

ITKINDIKISEENNNDIKYLPSFSKVLPEILNLYRNNPKNEPFDTIETEK

IVLNALIYVNKELYKKLILEDDLEENESKNIFLQELKKTLGNIDEIDENI

IENYYKNAQISASKGNNKAIKKYQKKVIECYIGYLRKNYEELFDFSDFKM

NIQEIKKQIKDINDNKTYERITVKTSDKTIVINDDFEYIISIFALLNSNA

VINKIRNRFFATSVWLNTSEYQNIIDILDEIMQLNTLRNECITENWNLNL

EEFIQKMKEIEKDFDDFKIQTKKEIFNNYYEDIKNNILTEFKDDINGCDV

LEKKLEKIVIFDDETKFEIDKKSNILQDEQRKLSNINKKDLKKKVDQYIK

DKDQEIKSKILCRIIFNSDFLKKYKKEIDNLIEDMESENENKFQEIYYPK

ERKNELYIYKKNLFLNIGNPNFDKIYGLISNDIKMADAKFLFNIDGKNIR

KNKISEIDAILKNLNDKLNGYSKEYKEKYIKKLKENDDFFAKNIQNKNYK

SFEKDYNRVSEYKKIRDLVEFNYLNKIESYLIDINWKLAIQMARFERDMH

YIVNGLRELGIIKLSGYNTGISRAYPKRNGSDGFYTTTAYYKFFDEESYK

KFEKICYGFGIDLSENSEINKPENESIRNYISHFYIVRNPFADYSIAEQI

DRVSNLLSYSTRYNNSTYASVFEVFKKDVNLDYDELKKKFKLIGNNDILE

RLMKPKKVSVLELESYNSDYIKNLIIELLTKIENTNDTL

C2c3, translated from >CEPX01008730.1 marine metagenome genome assembly TARA_037_MES_0.1-0.22, contig TARA_037_MES_0.1-0.22_scaffold22115_1, whole genome shotgun sequence.

(SEQ ID NO: 28)
MRSNYHGGRNARQWRKQISGLARRTKETVFTYKFPLETDAAEIDFDKAVQ

TYGIAEGVGHGSLIGLVCAFHLSGFRLFSKAGEAMAFRNRSRYPTDAFAE

KLSAIMGIQLPTLSPEGLDLIFQSPPRSRDGIAPVWSENEVRNRLYTNWT

GRGPANKPDEHLLEIAGEIAKQVFPKFGGWDDLASDPDKALAAADKYFQS

QGDFPSIASLPAAIMLSPANSTVDFEGDYIAIDPAAETLLHQAVSRCAAR

LGRERPDLDQNKGPFVSSLQDALVSSQNNGLSWLFGVGFQHWKEKSPKEL

IDEYKVPADQHGAVTQVKSFVDAIPLNPLFDTTHYGEFRASVAGKVRSWV

ANYWKRLLDLKSLLATTEFTLPESISDPKAVSLFSGLLVDPQGLKKVADS

LPARLVSAEEAIDRLMGVGIPTAADIAQVERVADEIGAFIGQVQQFNNQV

KQKLENLQDADDEEFLKGLKIELPSGDKEPPAINRISGGAPDAAAEISEL

EEKLQRLLDARSEHFQTISEWAEENAVTLDPIAAMVELERLRLAERGATG

DPEEYALRLLLQRIGRLANRVSPVSAGSIRELLKPVFMEEREFNLFFHNR

LGSLYRSPYSTSRHQPFSIDVGKAKAIDWIAGLDQISSDIEKALSGAGEA

-continued
LGDQLRDWINLAGFAISQRLRGLPDTVPNALAQVRCPDDVRIPPLLAMLL

EEDDIARDVCLKAFNLYVSAINGCLFGALREGFIVRTRFQRIGTDQIHYV

PKDKAWEYPDRLNTAKGPINAAVSSDWIEKDGAVIKPVETVRNLSSTGFA

GAGVSEYLVQAPHDWYTPLDLRDVAHLVTGLPVEKNITKLKRLTNRTAFR

MVGASSFKTHLDSVLLSDKIKLGDFTIIIDQHYRQSVTYGGKVKISYEPE

RLQVEAAVPVVDTRDRTVPEPDTLFDHIVAIDLGERSVGFAVFDIKSCLR

TGEVKPIHDNNGNPVVGTVAVPSIRRLMKAVRSHRRRRQPNQKVNQTYST

ALQNYRENVIGDVCNRIDTLMERYNAFPVLEFQIKNFQAGAKQLEIVYGS

In some embodiments, the nucleic acid programmable DNA binding protein (napDNAbp) of any of the fusion proteins provided herein is a Cas9 from archaea (e.g. nanoarchaea), which constitute a domain and kingdom of single-celled prokaryotic microbes. In some embodiments, the napDNAbp is CasX or CasY, which have been described in, for example, Burstein et al., "New CRISPR-Cas systems from uncultivated microbes." Cell Res. 2017 Feb. 21. doi: 10.1038/cr.2017.21, which is incorporated herein by reference. Using genome-resolved metagenomics, a number of CRISPR-Cas systems were identified, including the first reported Cas9 in the archaeal domain of life. This divergent Cas9 protein was found in nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp) and are within the scope of this disclosure.

In some embodiments, the nucleic acid programmable DNA binding protein (napDNAbp) of any of the fusion proteins provided herein is a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 29-31. In some embodiments, the napDNAbp comprises an amino acid sequence of any one SEQ ID NOs: 29-31. It should be appreciated that CasX and CasY from other bacterial species may also be used in accordance with the present disclosure.
CasX (uniprot.org/uniprot/F0NN87; uniprot.org/uniprot/F0NH53) >tr|F0NN87|F0NN87_SULIH CRISPR-associated Casx protein OS=*Sulfolobus islandicus* (strain HVE10/4) GN=SiH_0402 PE=4 SV=1

(SEQ ID NO: 29)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

-continued
TTVALSEVFKNFSQVKECEEVSAPSFVKPEFYEFGRSPGMVERTRRVKLE

VEPHYLIIAAAGWVLTRLGKAKVSEGDYVGVNVFTPTRGILYSLIQNVNG

IVPGIKPETAFGLWIARKVVSSVTNPNVSVVRIYTISDAVGQNPTTINGG

FSIDLTKLLEKRYLLSERLEAIARNALSISSNMRERYIVLANYIYEYLTG

SKRLEDLLYFANRDLIMNLNSDDGKVRDLKLISAYVNGELIRGEG

>tr|F0NH53|F0NH53_SULIR CRISPR associated protein, Casx OS=*Sulfolobus islandicus* (strain REY15A) GN=SiRe_0771 PE=4 SV=1

(SEQ ID NO: 30)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYKFGRSPGMVERTRRVKLE

VEPHYLIMAAAGWVLTRLGKAKVSEGDYVGVNVFTPTRGILYSLIQNVNG

IVPGIKPETAFGLWIARKVVSSVTNPNVSVVSIYTISDAVGQNPTTINGG

FSIDLTKLLEKRDLLSERLEAIARNALSISSNMRERYIVLANYIYEYLTG

SKRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY [uncultured Parcubacteria group bacterium]

(SEQ ID NO: 31)
MSKRHPRISGVKGYRLHAQRLEYTGKSGAMRTIKYPLYSSPSGGRTVPRE

IVSAINDDYVGLYGLSNFDDLYNAEKRNEEKVYSVLDFWYDCVQYGAVFS

YTAPGLLKNVAEVRGGSYELTKTLKGSHLYDELQIDKVIKFLNKKEISRA

NGSLDKLKKDIIDCFKAEYRERHKDQCNKLADDIKNAKKDAGASLGERQK

KLFRDFFGISEQSENDKPSFTNPLNLTCCLLPFDTVNNNRNRGEVLFNKL

KEYAQKLDKNEGSLEMWEYIGIGNSGTAFSNFLGEGFLGRLRENKITELK

KAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVS

SLLESIEKIVPDDSADDEKPDIPAIAIYRRFLSDGRLTLNRFVQREDVQE

ALIKERLEAEKKKKPKKRKKKSDAEDEKETIDFKELFPHLAKPLKLVPNF

YGDSKRELYKKYKNAAIYTDALWKAVEKIYKSAFSSSLKNSFFDTDFDKD

FFIKRLQKIFSVYRRFNTDKWKPIVKNSFAPYCDIVSLAENEVLYKPKQS

RSRKSAAIDKNRVRLPSTENIAKAGIALARELSVAGFDWKDLLKKEEHEE

YIDLIELHKTALALLLAVTETQLDISALDFVENGTVKDFMKTRDGNLVLE

GRFLEMFSQSIVFSELRGLAGLMSRKEFITRSAIQTMNGKQAELLYIPHE

FQSAKITTPKEMSRAFLDLAPAEFATSLEPESLSEKSLLKLKQMRYYPHY

FGYELTRTGQGIDGGVAENALRLEKSPVKKREIKCKQYKTLGRGQNKIVL

YVRSSYYQTQFLEWFLHRPKNVQTDVAVSGSFLIDEKKVKTRWNYDALTV

ALEPVSGSERVFVSQPFTIFPEKSAEEEGQRYLGIDIGEYGIAYTALEIT

GDSAKILDQNFISDPQLKTLREEVKGLKLDQRRGTFAMPSTKIARIRESL

VHSLRNRIHHLALKHKAKIVYELEVSRFEEGKQKIKKVYATLKKADVYSE

```
IDADKNLQTTVWGKLAVASEISASYTSQFCGACKKLWRAEMQVDETITTQ

ELIGTVRVIKGGTLIDAIKDFMRPPIFDENDTPFPKYRDFCDKHHISKKM

RGNSCLFICPFCRANADADIQASQTIALLRYVKEEKKVEDYFERFRKLKN

IKVLGQMKKI
```

Cas9 Domains of Nucleobase Editors

Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any Cas9 protein, such as any one of the Cas9 amino acid sequences as provided herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any Cas9 protein, such as any one of the Cas9 amino acid sequences as provided herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any Cas9 protein, such as any one of the Cas9 amino acid sequences as provided herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any Cas9 protein, such as any one of the Cas9 amino acid sequences as provided herein.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 6, or a corresponding mutation in any Cas9 protein, such as any one of the Cas9 amino acid sequences as provided herein, wherein X is any amino acid change. In some embodiments, the nuclease-inactive dCas9 domain comprises a D10A mutation and a H840A mutation of the amino acid sequence set forth in SEQ ID NO: 6, or a corresponding mutation in any Cas9 protein, such as any one of the Cas9 amino acid sequences as provided herein. As one example, a nuclease-inactive Cas9 domain comprises the amino acid sequence set forth in SEQ ID NO: 32 (Cloning vector pPlatTET-gRNA2, Accession No. BAV54124).

```
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVETSGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (SEQ ID NO: 32; see, e.g., Qi et al., Repurposing
CRISPR as an RNA-guided platform for sequence-
specific control of gene expression. Cell. 2013;
152(5):1173-83, the entire contents of which are
incorporated herein by reference).
```

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology*. 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any Cas9 protein, such as any one of the Cas9 amino acid sequences as provided herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any Cas9 protein, such as any one of the Cas9 amino acid sequences as provided herein.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 6, or a mutation in any Cas9 protein, such as any one of the Cas9 amino acid sequences as provided herein. For example, a Cas9 nickase may comprise the amino acid sequence as set forth in SEQ ID NO: 8. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 6, or a corresponding mutation in any Cas9 protein, such as any one of the Cas9 amino acid sequences as provided herein. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 33. In some embodiments, the SaCas9 comprises a N579X mutation of SEQ ID NO: 33, or a corresponding mutation in any Cas9 protein, such as any one of the Cas9 amino acid sequences as provided herein, wherein X is any amino acid except for N. In some embodiments, the SaCas9 comprises a N579A mutation of SEQ ID NO: 33, or a corresponding mutation in any Cas9 protein, such as any one of the Cas9 amino acid sequences as provided herein. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation of SEQ ID NO: 33, or a corresponding mutation in any Cas9 protein, such as any one of the Cas9 amino acid sequences as provided herein, wherein X is any amino acid. In some embodiments, the SaCas9 domain comprises one or more of a E781K, a N967K, and a R1014H mutation of SEQ ID NO: 33, or one or more corresponding mutation in any Cas9 protein, such as any one of the Cas9 amino acid sequences as provided herein. In some embodiments, the SaCas9 domain comprises a E781K, a N967K, or a R1014H mutation of SEQ ID NO: 33, or corresponding mutations in any Cas9 protein, such as any one of the Cas9 amino acid sequences as provided herein.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 33-36. In some embodiments, the Cas9 domain of any of the fusion proteins provided herein comprises the amino acid sequence of any one of SEQ ID NOs: 33-36. In some embodiments, the Cas9 domain of any of the fusion proteins provided herein consists of the amino acid sequence of any one of SEQ ID NOs: 33-36.

Exemplary SaCas9 Sequence (SEQ ID NO: 33)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

-continued
LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue N579 of SEQ ID NO: 33, which is underlined and in bold, may be mutated (e.g., to a A579) to yield a SaCas9 nickase.

Exemplary SaCas9d Sequence (SEQ ID NO: 34)
KRNYILGLAIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue D10 of SEQ ID NO: 34, which is underlined and in bold, may be mutated (e.g., to a A10) to yield a nuclease inactive SaCas9d.

Exemplary SaCas9n Sequence (SEQ ID NO: 35)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG.

Residue A579 of SEQ ID NO: 35, which can be mutated from N579 of SEQ ID NO: 33 to yield a SaCas9 nickase, is underlined and in bold.

Exemplary SaKKH Cas9

(SEQ ID NO: 36)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

```
-continued
NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITY

REYLENMNDKRPPHIIKTIASKTQSIKKYSTDILGNLYEVKSKKHPQIIK

KG.
```

Residue A579 of SEQ ID NO: 36, which can be mutated from N579 of SEQ ID NO: 36 to yield a SaCas9 nickase, is underlined and in bold. Residues K781, K967, and H1014 of SEQ ID NO: 36, which can be mutated from E781, N967, and R1014 of SEQ ID NO: 36 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 37. In some embodiments, the SpCas9 comprises a D9X mutation of SEQ ID NO: 37, or a corresponding mutation in any Cas9 protein, such as any one of the Cas9 amino acid sequences as provided herein, wherein X is any amino acid except for D. In some embodiments, the SpCas9 comprises a D9A mutation of SEQ ID NO: 37, or a corresponding mutation in any Cas9 protein, such as any one of the Cas9 amino acid sequences as provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 37, or a corresponding mutation in any Cas9 protein, such as any one of the Cas9 amino acid sequences as provided herein, wherein X is any amino acid. In some embodiments, the SpCas9 domain comprises one or more of a D1134E, R1334Q, and T1336R mutation of SEQ ID NO: 37, or a corresponding mutation in any Cas9 protein, such as any one of the Cas9 amino acid sequences as provided herein. In some embodiments, the SpCas9 domain comprises a D1134E, a R1334Q, and a T1336R mutation of SEQ ID NO: 37, or corresponding mutations in any Cas9 protein, such as any one of the Cas9 amino acid sequences as provided herein. In some embodiments, the SpCas9 domain comprises one or more of a D1134X, a R1334X, and a T1336X mutation of SEQ ID NO: 37, or a corresponding mutation in any Cas9 protein, such as any one of the Cas9 amino acid sequences as provided herein, wherein X is any amino acid. In some embodiments, the SpCas9 domain comprises one or more of a D1134V, a R1334Q, and a T1336R mutation of SEQ ID NO: 37, or a corresponding mutation in any Cas9 protein, such as any one of the Cas9 amino acid sequences as provided herein. In some embodiments, the SpCas9 domain comprises a D1134V, a R1334Q, and a T1336R mutation of SEQ ID NO: 37, or corresponding mutations in any Cas9 protein, such as any one of the Cas9 amino acid sequences as provided herein. In some embodiments, the SpCas9 domain comprises one or more of a D1134X, a G1217X, a R1334X, and a T1336X mutation of SEQ ID NO: 37, or a corresponding mutation in any Cas9 protein, such as any one of the Cas9 amino acid sequences as provided herein, wherein X is any amino acid. In some embodiments, the SpCas9 domain comprises one or more of a D1134V, a G1217R, a R1334Q, and a T1336R mutation of SEQ ID NO: 37, or a corresponding mutation in any Cas9 protein, such as any one of the Cas9 amino acid sequences as provided herein. In some embodiments, the SpCas9 domain comprises a D1134V, a G1217R, a R1334Q, and a T1336R mutation of SEQ ID NO: 37, or corresponding mutations in any Cas9 protein, such as any one of the Cas9 amino acid sequences as provided herein.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 37-41. In some embodiments, the Cas9 domain of any of the fusion proteins provided herein comprises the amino acid sequence of any one of SEQ ID NOs: 37-41. In some embodiments, the Cas9 domain of any of the fusion proteins provided herein consists of the amino acid sequence of any one of SEQ ID NOs: 37-41.

Exemplary SpCas9

```
                                      (SEQ ID NO: 37)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY
```

-continued

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpCas9n (SEQ ID NO: 38)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpEQR Cas9

(SEQ ID NO: 39)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGESPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD

Residues E1134, Q1334, and R1336 of SEQ ID NO: 39, which can be mutated from D1134, R1334, and T1336 of SEQ ID NO: 39 to yield a SpEQR Cas9, are underlined and in bold.

Exemplary SpVQR Cas9

(SEQ ID NO: 40)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

```
LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD
```

Residues V1134, Q1334, and R1336 of SEQ ID NO: 40, which can be mutated from D1134, R1334, and T1336 of SEQ ID NO: 40 to yield a SpVQR Cas9, are underlined and in bold.

Exemplary SpVRER Cas9

```
                                      (SEQ ID NO: 41)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASARELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKEYRSTKEVLDATLIHQS

ITGLYETRIDLSQLGGD
```

Residues V1134, R1217, Q1334, and R1336 of SEQ ID NO: 41, which can be mutated from D1134, G1217, R1334, and T1336 of SEQ ID NO: 41 to yield a SpVRER Cas9, are underlined and in bold.

The following are exemplary fusion proteins (e.g., base editing proteins) capable of binding to a nucleic acid sequence having a non-canonical (e.g., a non-NGG) PAM sequence:

Exemplary SaBE3 (rAPOBEC1-XTEN-SaCas9n-UGI-NLS)

```
                                      (SEQ ID NO: 42)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPESKRNYI

LGLDIGITSVGYGIIDYETRDVIDAGVRLFKEANVENNEGRRSKRGARRL

KRRRRHRIQRVKKLLFDYNLLTDHSELSGINPYEARVKGLSQKLSEEEFS

AALLHLAKRRGVHNVNEVEEDTGNELSTKEQISRNSKALEEKYVAELQLE

RLKKDGEVRGSINRFKTSDYVKEAKQLLKVQKAYHQLDQSFIDTYIDLLE

TRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVN

EEDIKGYRVTSTGKPEFTNLKVYHDIKDITARKEIIENAELLDQIAKILT

IYQSSEDIQEELTNLNSELTQEEIEQISNLKGYTGTHNLSLKAINLILDE

LWHTNDNQIAIFNRLKLVPKKVDLSQQKEIPTTLVDDFILSPVVKRSFIQ

SIKVINAIIKKYGLPNDIIIELAREKNSKDAQKMINEMQKRNRQTNERIE

EIIRTTGKENAKYLIEKIKLHDMQEGKCLYSLEAIPLEDLLNNPFNYEVD

HIIPRSVSFDNSFNNKVLVKQEEASKKGNRTPFQYLSSSDSKISYETFKK

HILNLAKGKGRISKTKKEYLLEERDINRFSVQKDFINRNLVDTRYATRGL
```

MNLLRSYFRVNNLDVKVKSINGGFTSFLRRKWKFKKERNKGYKHHAEDAL
IIANADFIFKEWKKLDKAKKVMENQMFEEKQAESMPEIETEQEYKEIFIT
PHQIKHIKDFKDYKYSHRVDKKPNRELINDTLYSTRKDDKGNTLIVNNLN
GLYDKDNDKLKKLINKSPEKLLMYHHDPQTYQKLKLIMEQYGDEKNPLYK
YYEETGNYLTKYSKKDNGPVIKKIKYYGNKLNAHLDITDDYPNSRNKVVK
LSLKPYRFDVYLDNGVYKFVTVKNLDVIKKENYYEVNSKCYEEAKKLKKI
SNQAEFIASFYNNDLIKINGELYRVIGVNNDLLNRIEVNMIDITYREYLE
NMNDKRPPRIIKTIASKTQSIKKYSTDILGNLYEVKSKKHPQIIKKGSGG
STNLSDIIEKETGKQLVIQESILMLPEEVEEVIGNKPESDILVHTAYDES
TDENVMLLTSDAPEYKPWALVIQDSNGENKIKMLSGGSPKKKRKV

Exemplary SaKKH-BE3 (rAPOBEC1-XTEN-SaCas9n-UGI-NLS)

(SEQ ID NO: 43)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESKRNYI
LGLDIGITSVGYGIIDYETRDVIDAGVRLFKEANVENNEGRRSKRGARRL
KRRRRHRIQRVKKLLFDYNLLTDHSELSGINPYEARVKGLSQKLSEEEFS
AALLHLAKRRGVHNVNEVEEDTGNELSTKEQISRNSKALEEKYVAELQLE
RLKKDGEVRGSINRFKTSDYVKEAKQLLKVQKAYHQLDQSFIDTYIDLLE
TRRTYYEGPGEGSPFGWKDIKEWYEMLMGHCTYFPEELRSVKYAYNADLY
NALNDLNNLVITRDENEKLEYYEKFQIIENVFKQKKKPTLKQIAKEILVN
EEDIKGYRVTSTGKPEFTNLKVYHDIKDITARKEIIENAELLDQIAKILT
IYQSSEDIQEELTNLNSELTQEEIEQISNLKGYTGTHNLSLKAINLILDE
LWHTNDNQIAIFNRLKLVPKKVDLSQQKEIPTTLVDDFILSPVVKRSFIQ
SIKVINAIIKKYGLPNDIIIELAREKNSKDAQKMINEMQKRNRQTNERIE
EIIRTTGKENAKYLIEKIKLHDMQEGKCLYSLEAIPLEDLLNNPFNYEVD
HIIPRSVSFDNSFNNKVLVKQEEASKKGNRTPFQYLSSSDSKISYETFKK
HILNLAKGKGRISKTKKEYLLEERDINRFSVQKDFINRNLVDTRYATRGL
MNLLRSYFRVNNLDVKVKSINGGFTSFLRRKWKFKKERNKGYKHHAEDAL
IIANADFIFKEWKKLDKAKKVMENQMFEEKQAESMPEIETEQEYKEIFIT
PHQIKHIKDFKDYKYSHRVDKKPNR*K*LINDTLYSTRKDDKGNTLIVNNLN
GLYDKDNDKLKKLINKSPEKLLMYHHDPQTYQKLKLIMEQYGDEKNPLYK
YYEETGNYLTKYSKKDNGPVIKKIKYYGNKLNAHLDITDDYPNSRNKVVK
LSLKPYRFDVYLDNGVYKFVTVKNLDVIKKENYYEVNSKCYEEAKKLKKI
SNQAEFIASFY*K*NDLIKINGELYRVIGVNNDLLNRIEVNMIDITYREYLE
NMNDKRPP*H*IIKTIASKTQSIKKYSTDILGNLYEVKSKKHPQIIKKGSGG
STNLSDIIEKETGKQLVIQESILMLPEEVEEVIGNKPESDILVHTAYDES
TDENVMLLTSDAPEYKPWALVIQDSNGENKIKMLSGGSPKKKRKV

Exemplary EQR-BE3 (rAPOBEC1-XTEN-Cas9n-UGI-NLS)

(SEQ ID NO: 44)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGF*E*SPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRK*Q*Y*R*STKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV

VQR-BE3 (rAPOBEC1-XTEN-Cas9n-UGI-NLS)

(SEQ ID NO: 45)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFVSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKQYRSTKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV

VRER-BE3 (rAPOBEC1-XTEN-Cas9n-UGI-NLS)

(SEQ ID NO: 46)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFVSPTVAYSVLVVAKVEKGKSKK
LKSVKELLGITIMERSSFEKNPIDFLEAKGYKEVKKDLIIKLPKYSLFEL
ENGRKRMLASARELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKEYRSTKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV

High Fidelity Base Editors

Some aspects of the disclosure provide Cas9 fusion proteins (e.g., any of the fusion proteins provided herein) comprising a Cas9 domain that has high fidelity. Additional aspects of the disclosure provide Cas9 fusion proteins (e.g., any of the fusion proteins provided herein) comprising a Cas9 domain with decreased electrostatic interactions between the Cas9 domain and a sugar-phosphate backbone of a DNA, as compared to a wild-type Cas9 domain. In some embodiments, a Cas9 domain (e.g., a wild type Cas9 domain) comprises one or more mutations that decreases the association between the Cas9 domain and a sugar-phosphate backbone of a DNA. In some embodiments, any of the Cas9 fusion proteins provided herein comprise one or more of a N497X, a R661X, a Q695X, and/or a Q926X mutation of the amino acid sequence provided in SEQ ID NO: 6, or a corresponding mutation in any Cas9 protein, such as any one of the Cas9 amino acid sequences as provided herein, wherein X is any amino acid. In some embodiments, any of the Cas9 fusion proteins provided herein comprise one or more of a N497A, a R661A, a Q695A, and/or a Q926A mutation of the amino acid sequence provided in SEQ ID NO: 6, or a corresponding mutation in any Cas9 protein, such as any one of the Cas9 amino acid sequences as provided herein. In some embodiments, the Cas9 domain comprises a D10A mutation of the amino acid sequence provided in SEQ ID NO: 6, or a corresponding mutation in any Cas9 protein, such as any one of the Cas9 amino acid sequences as provided herein. In some embodiments, the Cas9 domain (e.g., of any of the fusion proteins provided herein) comprises the amino acid sequence as set forth in SEQ ID NO: 47. In some embodiments, the fusion protein comprises the amino acid sequence as set forth in SEQ ID NO: 48. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that the base editors provided herein, for example, base editor 2 (BE2) or base editor 3 (BE3), may be converted into high fidelity base editors by modifying the Cas9 domain as described herein to generate high fidelity base editors, for example, high fidelity base editor 2 (HF-BE2) or high fidelity base editor 3 (HF-BE3). In some embodiments, base editor 2 (BE2) comprises a deaminase domain, a dCas9, and a UGI domain. In some embodiments, base editor 3 (BE3) comprises a deaminase domain, anCas9 domain and a UGI domain.

Cas9 Domain where Mutations Relative to Cas9 of SEQ ID NO: 6 are Shown in Bold and Underlines

```
                                        (SEQ ID NO: 47)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL
```

```
-continued
KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
```

HF-BE3

```
                                        (SEQ ID NO: 48)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPESDKKYS

IGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYL

ALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTFD

NGSIPHQIHLGELHAILRRQEDFYPFLKDNREKIEKILTFRIPYYVGPLA

RGNSRFAWMTRKSEETITPWNFEEVVDKGASAQSFIERMTAFDKNLPNEK

VLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRY

TGWGALSRKLINGIRDKQSGKTILDFLKSDGFANRNFMALIHDDSLTFKE

DIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERG
```

-continued

GLSELDKAGFIKRQLVETRAITKHVAQILDSRMNTKYDENDKLIREVKVI

TLKSKLVSDFRKDFQFYKVREINNYHHAHDAYLNAVVGTALIKKYPKLES

EFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFS

KESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLY

ETRIDLSQLGGD

Cas9 Fusion Proteins

Any of the Cas9 domains (e.g., a nuclease active Cas9 protein, a nuclease-inactive dCas9 protein, or a Cas9 nickase protein) disclosed herein may be fused to a second protein, thus fusion proteins provided herein comprise a Cas9 domain as provided herein and a second protein, or a "fusion partner". In some embodiments, the second protein is fused to the N-terminus of the Cas9 domain. However, in other embodiments, the second protein is fused to the C-terminus of the Cas9 domain. In some embodiments, the second protein that is fused to the Cas9 domain is a nucleic acid editing domain. In some embodiments, the Cas9 domain and the nucleic acid editing domain are fused via a linker, while in other embodiments the Cas9 domain and the nucleic acid editing domain are fused directly to one another. In some embodiments, the Cas9 domain and the nucleic acid editing domain are fused via a linker of any length or composition. For example, the linker may be a bond, one or more amino acids, a peptide, or a polymer, of any length and composition. In some embodiments, the linker comprises $(GGGS)_n$ (SEQ ID NO: 613), $(GGGGS)_n$ (SEQ ID NO: 607), $(G)_n$ (SEQ ID NO: 608), $(EAAAK)_n$ (SEQ ID NO: 609), $(GGS)_n$ (SEQ ID NO: 610), $(SGGS)_n$ (SEQ ID NO: 606), SGSETPGTSESATPES (SEQ ID NO: 604), $SGGS(GGS)_n$ (SEQ ID NO: 612), SGGSSGGSSGSETPGTSESATPESSGGSSGGS (SEQ ID NO: 605), or $(XP)_n$ (SEQ ID NO: 611) motif, or a combination of any of these, wherein n is independently an integer between 1 and 30, and wherein X is any amino acid. In some embodiments, the linker comprises a $(GGS)_n$ motif, wherein n is 1, 3, or 7. In some embodiments, the linker comprises a $(GGS)_n$ (SEQ ID NO: 610) motif, wherein n is 1, 2, 3, 4, 5, 6, 7, 8, 9, 10, 11, 12, 13, 14, or 15. In some embodiments, the linker comprises the amino acid sequence $SGGS(GGS)_n$ (SEQ ID NO: 612), wherein n is 1, 2, 3, 4, 5, 6, 7, 8, 9, or 10. In some embodiments, the linker comprises the amino acid sequence $SGGS(GGS)_n$ (SEQ ID NO: 612), wherein n is 2. In some embodiments, the linker comprises an amino acid sequence of SGSETPGTSESATPES (SEQ ID NO: 604), also referred to as the XTEN linker in the Examples). In some embodiments, the linker comprises the amino acid sequence SGGSSGGSSGSETPGTSESATPESSGGSSGGS (SEQ ID NO: 605), also referred to as the 32 amino acid linker in the Examples. The length of the linker can influence the base to be edited, as illustrated in the Examples. For example, a linker of 3-amino-acid long (e.g., $(GGS)_1$) may give a 2-5, 2-4, 2-3, 3-4 base editing window relative to the PAM sequence, while a 9-amino-acid linker (e.g., $(GGS)_3$ (SEQ ID NO: 610)) may give a 2-6, 2-5, 2-4, 2-3, 3-6, 3-5, 3-4, 4-6, 4-5, 5-6 base editing window relative to the PAM sequence. A 16-amino-acid linker (e.g., the XTEN linker) may give a 2-7, 2-6, 2-5, 2-4, 2-3, 3-7, 3-6, 3-5, 3-4, 4-7, 4-6, 4-5, 5-7, 5-6, 6-7 base window relative to the PAM sequence with exceptionally strong activity, and a 21-amino-acid linker (e.g., $(GGS)_7$ (SEQ ID NO: 610)) may give a 3-8, 3-7, 3-6, 3-5, 3-4, 4-8, 4-7, 4-6, 4-5, 5-8, 5-7, 5-6, 6-8, 6-7, 7-8 base editing window relative to the PAM sequence. The novel finding that varying linker length may allow the dCas9 fusion proteins of the disclosure to edit nucleobases different distances from the PAM sequence affords significant clinical importance, since a PAM sequence may be of varying distance to the disease-causing mutation to be corrected in a gene. It is to be understood that the linker lengths described as examples here are not meant to be limiting.

In some embodiments, the second protein comprises an enzymatic domain. In some embodiments, the enzymatic domain is a nucleic acid editing domain. Such a nucleic acid editing domain may be, without limitation, a nuclease, a nickase, a recombinase, a deaminase, a methyltransferase, a methylase, an acetylase, or an acetyltransferase. Non-limiting exemplary binding domains that may be used in accordance with this disclosure include transcriptional activator domains and transcriptional repressor domains.

Deaminase Domains

In some embodiments, second protein comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is an activation-induced cytidine deaminase (AID). In some embodiments, the deaminase is a cytidine deaminase 1 (CDA1). In some embodiments, the deaminase is a *Petromyzon marinus* cytidine deaminase 1 (pmCDA1). In some embodiments, the deaminase is a human APOBEC3G (SEQ ID NO: 60). In some embodiments, the deaminase is a fragment of the human APOBEC3G (SEQ ID NO: 83). In some embodiments, the deaminase is a human APOBEC3G variant comprising a D316R_D317R mutation (SEQ ID NO: 82). In some embodiments, the deaminase is a fragment of the human APOBEC3G and comprising mutations corresponding to the D316R_D317R mutations in SEQ ID NO: 60 (SEQ ID NO: 84).

In some embodiments, the nucleic acid editing domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 49-84. In some embodiments, the nucleic acid editing domain comprises the amino acid sequence of any one of SEQ ID NOs: 49-84.

Deaminase Domains that Modulate the Editing Window of Base Editors

Some aspects of the disclosure are based on the recognition that modulating the deaminase domain catalytic activity of any of the fusion proteins provided herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deaminataion window may prevent unwanted deamination of residues adjacent of specific target residues, which may decrease or prevent off-target effects.

In some embodiments, any of the fusion proteins provided herein comprise a deaminase domain (e.g., a cytidine deaminase domain) that has reduced catalytic deaminase activity. In some embodiments, any of the fusion proteins provided herein comprise a deaminase domain (e.g., a cytidine deaminase domain) that has a reduced catalytic deaminase activity as compared to an appropriate control. For example, the appropriate control may be the deaminase activity of the deaminase prior to introducing one or more mutations into the deaminase. In other embodiments, the appropriate control may be a wild-type deaminase. In some embodiments, the appropriate control is a wild-type apolipoprotein B mRNA-editing complex (APOBEC) family deaminase. In some embodiments, the appropriate control is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, or an APOBEC3H deaminase. In some embodiments, the appropriate control is an activation induced deaminase (AID). In some embodiments, the appropriate control is a cytidine deaminase 1 from *Petromyzon marinus* (pmCDA1). In some embodiments, the deaminase domain may be a deaminase domain that has at least 1%, at least 5%, at least 15%, at least 20%, at least 25%, at least 30%, at least 40%, at least 50%, at least 60%, at least 70%, at least 80%, at least 90%, or at least 95% less catalytic deaminase activity as compared to an appropriate control.

In some embodiments, any of the fusion proteins provided herein comprise an APOBEC deaminase comprising one or more mutations selected from the group consisting of H121X, H122X, R126X, R126X, R118X, W90X, W90X, and R132X of rAPOBEC1 (SEQ ID NO: 76), or one or more corresponding mutations in another APOBEC deaminase, wherein X is any amino acid. In some embodiments, any of the fusion proteins provided herein comprise an APOBEC deaminase comprising one or more mutations selected from the group consisting of H121R, H122R, R126A, R126E, R118A, W90A, W90Y, and R132E of rAPOBEC1 (SEQ ID NO: 76), or one or more corresponding mutations in another APOBEC deaminase.

In some embodiments, any of the fusion proteins provided herein comprise an APOBEC deaminase comprising one or more mutations selected from the group consisting of D316X, D317X, R320X, R320X, R313X, W285X, W285X, R326X of hAPOBEC3G (SEQ ID NO: 60), or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G (SEQ ID NO: 60), or one or more corresponding mutations in another APOBEC deaminase.

In some embodiments, any of the fusion proteins provided herein comprise an APOBEC deaminase comprising a H121R and a H122R mutation of rAPOBEC1 (SEQ ID NO: 76), or one or more corresponding mutations in another APOBEC deaminase. In some embodiments, any of the fusion proteins provided herein comprise an APOBEC deaminase comprising a R126A mutation of rAPOBEC1 (SEQ ID NO: 76), or one or more corresponding mutations in another APOBEC deaminase. In some embodiments, any of the fusion proteins provided herein comprise an APOBEC deaminase comprising a R126E mutation of rAPOBEC1 (SEQ ID NO: 76), or one or more corresponding mutations in another APOBEC deaminase. In some embodiments, any of the fusion proteins provided herein comprise an APOBEC deaminase comprising a R118A mutation of rAPOBEC1 (SEQ ID NO: 76), or one or more corresponding mutations in another APOBEC deaminase. In some embodiments, any of the fusion proteins provided herein comprise an APOBEC deaminase comprising a W90A mutation of rAPOBEC1 (SEQ ID NO: 76), or one or more corresponding mutations in another APOBEC deaminase. In some embodiments, any of the fusion proteins provided herein comprise an APOBEC deaminase comprising a W90Y mutation of rAPOBEC1 (SEQ ID NO: 76), or one or more corresponding mutations in another APOBEC deaminase. In some embodiments, any of the fusion proteins provided herein comprise an APOBEC deaminase comprising a R132E mutation of rAPOBEC1 (SEQ ID NO: 76), or one or more corresponding mutations in another APOBEC deaminase. In some embodiments, any of the fusion proteins provided herein comprise an APOBEC deaminase comprising a W90Y and a R126E mutation of rAPOBEC1 (SEQ ID NO: 76), or one or more corresponding mutations in another APOBEC deaminase. In some embodiments, any of the fusion proteins provided herein comprise an APOBEC deaminase comprising a R126E and a R132E mutation of rAPOBEC1 (SEQ ID NO: 76), or one or more corresponding mutations in another APOBEC deaminase. In some embodiments, any of the fusion proteins provided herein comprise an APOBEC deaminase comprising a W90Y and a R132E mutation of rAPOBEC1 (SEQ ID NO: 76), or one or more corresponding mutations in another APOBEC deaminase. In some embodiments, any of the fusion proteins provided herein comprise an APOBEC deaminase comprising a W90Y, R126E, and R132E mutation of rAPOBEC1 (SEQ ID NO: 76), or one or more corresponding mutations in another APOBEC deaminase.

In some embodiments, any of the fusion proteins provided herein comprise an APOBEC deaminase comprising a D316R and a D317R mutation of hAPOBEC3G (SEQ ID NO: 60), or one or more corresponding mutations in another APOBEC deaminase. In some embodiments, any of the fusion proteins provided herein comprise an APOBEC deaminase comprising a R320A mutation of hAPOBEC3G (SEQ ID NO: 60), or one or more corresponding mutations in another APOBEC deaminase. In some embodiments, any of the fusion proteins provided herein comprise an APOBEC deaminase comprising a R320E mutation of hAPOBEC3G (SEQ ID NO: 60), or one or more corresponding mutations in another APOBEC deaminase. In some embodiments, any of the fusion proteins provided herein comprise an APOBEC deaminase comprising a R313A mutation of hAPOBEC3G (SEQ ID NO: 60), or one or more corresponding mutations in another APOBEC deaminase. In some embodiments, any of the fusion proteins provided herein comprise an APOBEC deaminase comprising a W285A mutation of hAPOBEC3G (SEQ ID NO: 60), or one or more corresponding mutations in another APOBEC deaminase. In some embodiments, any of the fusion proteins provided herein comprise an APOBEC deaminase comprising a W285Y mutation of hAPOBEC3G (SEQ ID NO: 60), or one or more corresponding mutations in another APOBEC deaminase. In some embodiments, any of the fusion proteins provided herein comprise an APOBEC deaminase comprising a R326E mutation of hAPOBEC3G (SEQ ID NO: 60), or one or more corresponding mutations in another APOBEC deaminase. In some embodiments, any of the fusion proteins provided herein comprise an APOBEC deaminase comprising a W285Y and a R320E mutation of hAPOBEC3G (SEQ ID NO: 60), or one or more corresponding mutations in another APOBEC deaminase. In some embodiments, any of the fusion proteins provided herein comprise an APOBEC deaminase comprising a R320E and a R326E mutation of hAPOBEC3G (SEQ ID NO: 60), or one or more corresponding mutations in another APOBEC deaminase. In some embodiments, any of the fusion proteins provided herein comprise an APOBEC deaminase comprising a W285Y and a R326E mutation of hAPOBEC3G (SEQ ID NO: 60), or one or more corresponding mutations in another APOBEC deaminase. In some embodiments, any of the fusion proteins provided herein comprise an APOBEC deaminase comprising a W285Y, R320E, and R326E mutation of hAPOBEC3G (SEQ ID NO: 60), or one or more corresponding mutations in another APOBEC deaminase.

Some aspects of this disclosure provide fusion proteins comprising (i) a nuclease-inactive Cas9 domain; and (ii) a nucleic acid editing domain. In some embodiments, a nuclease-inactive Cas9 domain (dCas9), comprises an amino acid sequence that is at least 80%, at least 85%, at least 90%, at least 92%, at least 95%, at least 96%, at least 97%, at least 98%, at least 99%, or at least 99.5% identical to the amino acid sequence of a Cas9 as provided by any Cas9 protein, such as any one of the Cas9 amino acid sequences as provided herein, and comprises mutations that inactivate the nuclease activity of Cas9. Mutations that render the nuclease domains of Cas9 inactive are well-known in the art. For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of S. pyogenes Cas9 (Jinek et al., Science. 337:816-821(2012); Qi et al., Cell. 28; 152(5):1173-83 (2013)). In some embodiments, the dCas9 of this disclosure comprises a D10A mutation of the amino acid sequence provided in SEQ ID NO: 6, or a corresponding mutation in any Cas9 protein, such as any one of the Cas9 amino acid sequences as provided herein. In some embodiments, the dCas9 of this disclosure comprises a H840A mutation of the amino acid sequence provided in SEQ ID NO: 6, or a corresponding mutation in any Cas9 protein, such as any one of the Cas9 amino acid sequences as provided herein. In some embodiments, the dCas9 of this disclosure comprises both D10A and H840A mutations of the amino acid sequence provided in SEQ ID NO: 6, or a corresponding mutation in any Cas9 protein, such as any one of the Cas9 amino acid sequences as provided herein. In some embodiments, the Cas9 further comprises a histidine residue at position 840 of the amino acid sequence provided in SEQ ID NO: 6, or a corresponding mutation in any Cas9 protein, such as any one of the Cas9 amino acid sequences as provided herein. The presence of the catalytic residue H840 restores the activity of the Cas9 to cleave the non-edited strand containing a G opposite the targeted C. Restoration of H840 does not result in the cleavage of the target strand containing the C. In some embodiments, the dCas9 comprises an amino acid sequence of SEQ ID NO: 32. It is to be understood that other mutations that inactivate the nuclease domains of Cas9 may also be included in the dCas9 of this disclosure.

The Cas9 or dCas9 domains comprising the mutations disclosed herein, may be a full-length Cas9, or a fragment thereof. In some embodiments, proteins comprising Cas9, or fragments thereof, are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9, e.g., a Cas9 comprising the amino acid sequence of SEQ ID NO: 6.

Any of the Cas9 fusion proteins of this disclosure may further comprise a nucleic acid editing domain (e.g., an enzyme that is capable of modifying nucleic acid, such as a deaminase). In some embodiments, the nucleic acid editing domain is a DNA-editing domain. In some embodiments, the nucleic acid editing domain has deaminase activity. In some embodiments, the nucleic acid editing domain comprises or consists of a deaminase or deaminase domain. In some embodiments, the deaminase is a cytidine deaminase. In some embodiments, the deaminase is an apolipoprotein B mRNA-editing complex (APOBEC) family deaminase. In some embodiments, the deaminase is an APOBEC1 family deaminase. In some embodiments, the deaminase is an activation-induced cytidine deaminase (AID). Some nucleic-acid editing domains as well as Cas9 fusion proteins including such domains are described in detail herein. Additional suitable nucleic acid editing domains will be apparent to the skilled artisan based on this disclosure and knowledge in the field.

Some aspects of the disclosure provide a fusion protein comprising a Cas9 domain fused to a nucleic acid editing domain, wherein the nucleic acid editing domain is fused to the N-terminus of the Cas9 domain. In some embodiments, the Cas9 domain and the nucleic acid editing-editing domain are fused via a linker. In some embodiments, the linker comprises a (GGGS)$_n$ (SEQ ID NO: 613), a (GGGGS)$_n$ (SEQ ID NO: 607), a (G)$_n$(SEQ ID NO: 608), an (EAAAK)$_n$ (SEQ ID NO: 609), a (GGS)$_n$(SEQ ID NO: 610), (SGGS)$_n$(SEQ ID NO: 606), an SGSETPGTSESATPES (SEQ ID NO: 604) motif (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference), or an (XP)$_n$ (SEQ ID NO: 611) motif, or a combination of any of these, wherein n is independently an integer between 1 and 30. In some embodiments, n is independently 1, 2, 3,4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. In some embodiments, the linker comprises a (GGS)$_n$(SEQ ID NO: 610) motif, wherein n is 1, 2, 3, 4, 5, 6, 7, 8, 9, 10, 11, 12, 13, 14 or 15. In some embodiments, the linker comprises a (GGS)$_n$(SEQ ID NO: 610) motif, wherein n is 1, 3, or 7. In some embodiments, the linker comprises the amino acid sequence SGSETPGTSESATPES (SEQ ID NO: 604). Additional suitable linker motifs and linker configurations will be apparent to those of skill in the art. In some embodiments, suitable linker motifs and configurations include those described in Chen et al., Fusion protein linkers: property, design and functionality. *Adv Drug Deliv Rev.* 2013; 65(10):1357-69, the entire contents of which are incorporated herein by reference. Additional suitable linker sequences will be apparent to those of skill in the art based on the instant disclosure. In some embodiments, the general architecture of exemplary Cas9 fusion proteins provided herein comprises the structure:

[NH$_2$]-[nucleic acid editing domain]-[Cas9]-[COOH]

or

[NH$_2$]-[nucleic acid editing domain]-[linker]-[Cas9]-[COOH], wherein NH$_2$ is the N-terminus of the fusion protein, and COOH is the C-terminus of the fusion protein.

The fusion proteins of the present disclosure may comprise one or more additional features. For example, in some embodiments, the fusion protein comprises a nuclear localization sequence (NLS). In some embodiments, the NLS of the fusion protein is localized between the nucleic acid editing domain and the Cas9 domain. In some embodiments, the NLS of the fusion protein is localized C-terminal to the Cas9 domain.

Other exemplary features that may be present are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

In some embodiments, the nucleic acid editing domain is a deaminase. For example, in some embodiments, the general architecture of exemplary Cas9 fusion proteins with a deaminase domain comprises the structure:

[NH$_2$]-[NLS]-[deaminase]-[Cas9]-[COOH],

[NH$_2$]-[Cas9]-[deaminase]-[COOH],

[NH$_2$]-[deaminase]-[Cas9]-[COOH], or

[NH$_2$]-[deaminase]-[Cas9]-[NLS]-[COOH];

wherein NLS is a nuclear localization sequence, NH$_2$ is the N-terminus of the fusion protein, and COOH is the C-terminus of the fusion protein. Nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 614) or MDSLLMNRRKFLYQFKNVRWAKGR-RETYLC (SEQ ID NO: 615). In some embodiments, a linker is inserted between the Cas9 and the deaminase. In some embodiments, the NLS is located C-terminal of the Cas9 domain. In some embodiments, the NLS is located N-terminal of the Cas9 domain. In some embodiments, the NLS is located between the deaminase and the Cas9 domain. In some embodiments, the NLS is located N-terminal of the deaminase domain. In some embodiments, the NLS is located C-terminal of the deaminase domain.

One exemplary suitable type of nucleic acid editing domain is a cytidine deaminase, for example, of the APOBEC family. The apolipoprotein B mRNA-editing complex (APOBEC) family of cytidine deaminase enzymes encompasses eleven proteins that serve to initiate mutagenesis in a controlled and beneficial manner.[29] One family member, activation-induced cytidine deaminase (AID), is responsible for the maturation of antibodies by converting cytosines in ssDNA to uracils in a transcription-dependent, strand-biased fashion.[30] The apolipoprotein B editing complex 3 (APOBEC3) enzyme provides protection to human cells against a certain HIV-1 strain via the deamination of cytosines in reverse-transcribed viral ssDNA.[31] These proteins all require a Zn$^{2+}$-coordinating motif (His-X-Glu-X$_{23-26}$-Pro-Cys-X$_{2-4}$-Cys; SEQ ID NO: 616) and bound water molecule for catalytic activity. The Glu residue acts to activate the water molecule to a zinc hydroxide for nucleophilic attack in the deamination reaction. Each family member preferentially deaminates at its own particular "hotspot", ranging from WRC (W is A or T, R is A or G) for hAID, to TTC for hAPOBEC3F.[32] A recent crystal structure of the catalytic domain of APOBEC3G revealed a secondary structure comprised of a five-stranded j-sheet core flanked by six a-helices, which is believed to be conserved across the entire family.[33] The active center loops have been shown to be responsible for both ssDNA binding and in determining "hotspot" identity.[34] Overexpression of these enzymes has been linked to genomic instability and cancer, thus highlighting the importance of sequence-specific targeting.[35]

Some aspects of this disclosure relate to the recognition that the activity of cytidine deaminase enzymes such as APOBEC enzymes can be directed to a specific site in genomic DNA. Without wishing to be bound by any particular theory, advantages of using Cas9 as a recognition agent include (1) the sequence specificity of Cas9 can be easily altered by simply changing the sgRNA sequence; and (2) Cas9 binds to its target sequence by denaturing the dsDNA, resulting in a stretch of DNA that is single-stranded and therefore a viable substrate for the deaminase. It should be understood that other catalytic domains, or catalytic domains from other deaminases, can also be used to generate fusion proteins with Cas9, and that the disclosure is not limited in this regard.

Figure 3:
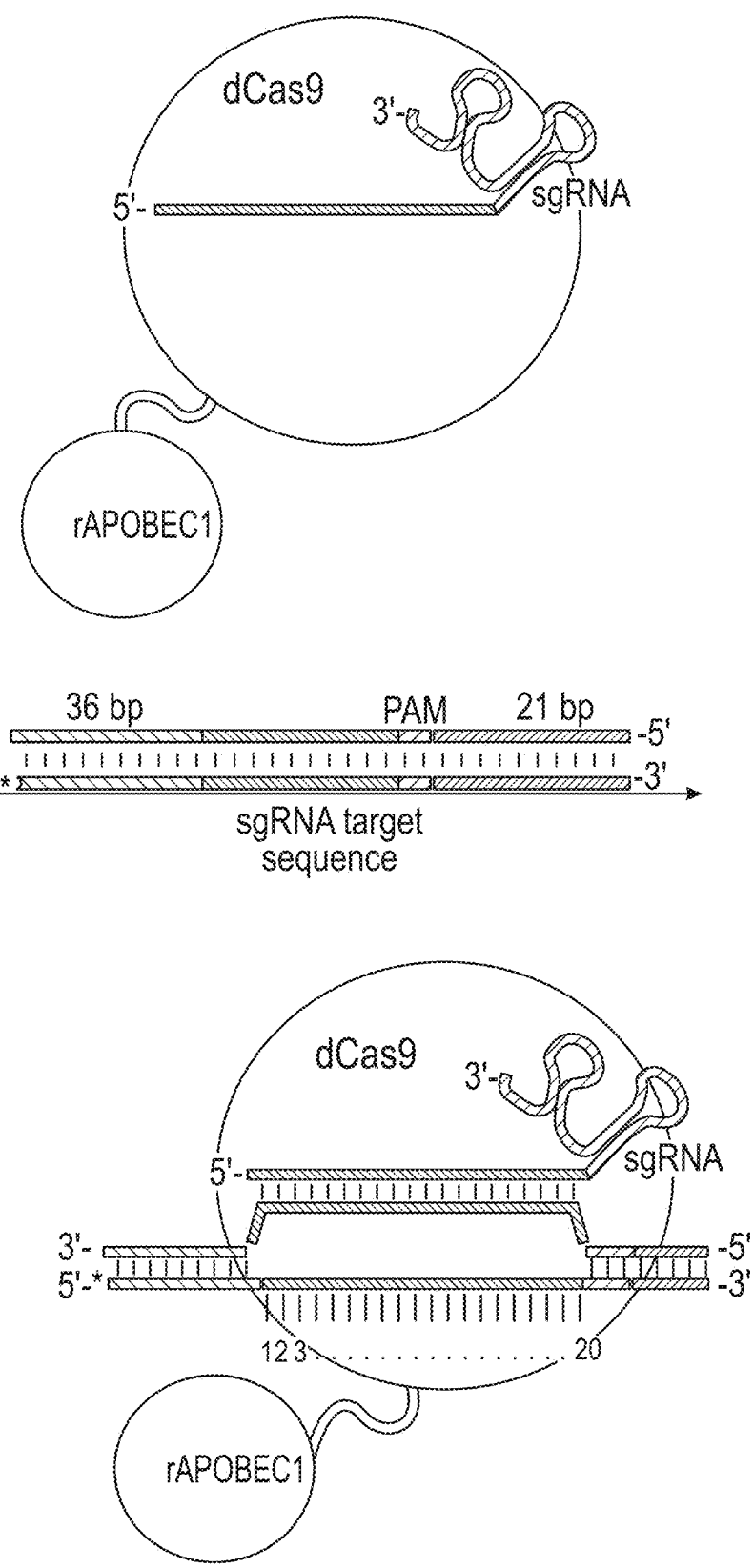
FIG. 3 illustrates double stranded DNA substrate binding by Cas9:deaminase:sgRNA complexes.

Some aspects of this disclosure are based on the recognition that Cas9:deaminase fusion proteins can efficiently deaminate nucleotides at positions 3-11 according to the numbering scheme in FIG. 3. In view of the results provided herein regarding the nucleotides that can be targeted by Cas9:deaminase fusion proteins, a person of skill in the art will be able to design suitable guide RNAs to target the fusion proteins to a target sequence that comprises a nucleotide to be deaminated.

In some embodiments, the deaminase domain and the Cas9 domain are fused to each other via a linker. Various linker lengths and flexibilities between the deaminase domain (e.g., AID) and the Cas9 domain can be employed (e.g., ranging from very flexible linkers of the form (GGGGS)$_n$ (SEQ ID NO: 607), (GGS)$_n$(SEQ ID NO: 610), and (G)$_n$ (SEQ ID NO: 608) to more rigid linkers of the form (EAAAK)$_n$ (SEQ ID NO: 609), (SGGS)$_n$(SEQ ID NO: 606), SGSETPGTSESATPES (SEQ ID NO: 604) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP)$_n$ (SEQ ID NO: 611))[36] in order to achieve the optimal length for deaminase activity for the specific application. In some embodiments, the linker comprises a (GGS)$_n$ (SEQ ID NO: 610) motif, wherein n is 1, 3, or 7. In some embodiments, the linker comprises a (an SGSETPGTS-ESATPES (SEQ ID NO: 604) motif.

Some exemplary suitable nucleic-acid editing domains, e.g., deaminases and deaminase domains, that can be fused to Cas9 domains according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Human AID:

(SEQ ID NO: 49)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPNLSLRIFTARLYFCEDRKAEPEGLRRLHRAGVQIAIMTFKDYFYCWNT

FVENHERTFKAWEGLHENSVRLSRQLRRILLPLYEVDDLRDAFRTLGL (underline: nuclear localization sequence; double underline: nuclear export signal)
Mouse AID:

(SEQ ID NO: 51)
MDSLLMKQKKFLYHFKNVRWAKGRHETYLCYVVKRRDSATSCSLDFGHLR

NKSGCHVELLFLRYISDWDLDPGRCYRVTWFTSWSPCYDCARHVAEFLRW

NPNLSLRIFTARLYFCEDRKAEPEGLRRLHRAGVQIGIMTFKDYFYCWNT

FVENRERTFKAWEGLHENSVRLTRQLRRILLPLYEVDDLRDAFRMLGF (underline: nuclear localization sequence; double underline: nuclear export signal)
Dog AID:

(SEQ ID NO: 52)
MDSLLMKQRKFLYHFKNVRWAKGRHETYLCYVVKRRDSATSFSLDFGHLR

NKSGCHVELLFLRYISDWDLDPGRCYRVTWFTSWSPCYDCARHVADFLRG

YPNLSLRIFAARLYFCEDRKAEPEGLRRLHRAGVQIAIMTFKDYFYCWNT

FVENREKTFKAWEGLHENSVRLSRQLRRILLPLYEVDDLRDAFRTLGL (underline: nuclear localization sequence; double underline: nuclear export signal)
Bovine AID:

(SEQ ID NO: 53)
MDSLLKKQRQFLYQFKNVRWAKGRHETYLCYVVKRRDSPTSFSLDFGHLR

NKAGCHVELLFLRYISDWDLDPGRCYRVTWFTSWSPCYDCARHVADFLRG

YPNLSLRIFTARLYFCDKERKAEPEGLRRLHRAGVQIAIMTFKDYFYCWN

TFVENHERTFKAWEGLHENSVRLSRQLRRILLPLYEVDDLRDAFRTLGL (underline: nuclear localization sequence; double underline: nuclear export signal)

(SEQ ID NO: 54)
Rat:AID:MAVGSKPKAALVGPHWERERIWCFLCSTGLGTQQTGQTSRWL

RPAATQDPVSPPRSLLMKQRKFLYHFKNVRWAKGRHETYLCYVVKRRDSA

TSFSLDFGYLRNKSGCHVELLFLRYISDWDLDPGRCYRVTWFTSWSPCYD

CARHVADFLRGNPNLSLRIFTARLTGWGALPAGLMSPARPSDYFYCWNTF

VENHERTFKAWEGLHENSVRLSRRLRRILLPLYEVDDLRDAFRTLGL (underline: nuclear localization sequence; double underline: nuclear export signal)
Mouse APOBEC-3:

(SEQ ID NO: 55)
MGPFCLGCSHRKCYSPIRNLISQETFKFHFKNLGYAKGRKDTFLCYEVTR

KDCDSPVSLHHGVFKNKDNI*HAEICFLYWFHDKVLKVLSPREEFKITWYM*

*SWSPCFEC*AEQIVRFLATHHNLSLDIFSSRLYNVQDPETQQNLCRLVQEG

AQVAAMDLYEFKKCWKKFVDNGGRRFRPWKRLLTNFRYQDSKLQEILRPC

YIPVPSSSSSTLSNICLTKGLPETRFCVEGRRMDPLSEEEFYSQFYNQRV

KHLCYYHRMKPYLCYQLEQFNGQAPLKGCLLSEKGKQ*HAEILFLDKIRSM*

*ELSQVTITCYLTWSPCPNC*AWQLAAFKRDRPDLILHIYTSRLYFHWKRPF

QKGLCSLWQSGILVDVMDLPQFTDCWTNFVNPKRPFWPWKGLEIISRRTQ

RRLRRIKESWGLQDLVNDFGNLQLGPPMS (italic: nucleic acid editing domain)
Rat APOBEC-3:

(SEQ ID NO: 56)
MGPFCLGCSHRKCYSPIRNLISQETFKFHFKNLRYAIDRKDTFLCYEVTR

KDCDSPVSLHHGVFKNKDNI*HAEICFLYWFHDKVLKVLSPREEFKITWYM*

*SWSPCFEC*AEQVLRFLATHHNLSLDIFSSRLYNIRDPENQQNLCRLVQEG

AQVAAMDLYEFKKCWKKFVDNGGRRFRPWKKLLTNFRYQDSKLQEILRPC

YIPVPSSSSSTLSNICLTKGLPETRFCVERRRVHLLSEEEFYSQFYNQRV

KHLCYYHGVKPYLCYQLEQFNGQAPLKGCLLSEKGKQ*HAEILFLDKIRSM*

*ELSQVIITCYLTWSPCPNC*AWQLAAFKRDRPDLILHIYTSRLYFHWKRPF

QKGLCSLWQSGILVDVMDLPQFTDCWTNFVNPKRPFWPWKGLEIISRRTQ

RRLHRIKESWGLQDLVNDFGNLQLGPPMS (italic: nucleic acid editing domain)
Rhesus macaque APOBEC-3G:

(SEQ ID NO: 57)
MVEPMDPRTFVSNFNNRPILSGLNTVWLCCEVKTKDPSGPPLDAKIFQGK

VYSKAKYHPEMRFLRWFHKWRQLHHDQEYKVTWYVSWSPCTRCANSVATF

LAKDPKVTLTIFVARLYYFWKPDYQQALRILCQKRGGPHATMKIMNYNEF

QDCWNKFVDGRGKPFKPRNNLPKHYTLLQATLGELLRHLMDPGTFTSNFN

NKPWVSGQHETYLCYKVERLHNDTWVPLNQHRGFLRNQAPNIHGFPKGR*H*

*AELCFLDLIPFWKLDGQQYRVTCFTSWSPCFSC*AQEMAKFISNNEHVSLC

IFAARIYDDQGRYQEGLRALHRDGAKIAMMNYSEFEYCWDTFVDRQGRPF

QPWDGLDEHSQALSGRLRAI (italic: nucleic acid editing domain; underline: cytoplasmic localization signal)
Chimpanzee APOBEC-3G:

(SEQ ID NO: 58)
MKPHFRNPVERMYQDTFSDNFYNRPILSHRNTVWLCYEVKTKGPSRPPLD

AKIFRGQVYSKLKYHPEMRFFHWFSKWRKLHRDQEYEVTWYISWSPCTKC

TRDVATFLAEDPKVTLTIFVARLYYFWDPDYQEALRSLCQKRDGPRATMK

IMNYDEFQHCWSKFVYSQRELFEPWNNLPKYYILLHIMLGEILRHSMDPP

TFTSNFNELWVRGRHETYLCYEVERLHNDTWVLLNQRRGFLCNQAPHKH

GFLEGR*HAELCFLDVIPFWKLDLHQDYRVTCFTSWSPCFSC*AQEMAKFIS

NNKHVSLCIFAARIYDDQGRCQEGLRTLAKAGAKISIMTYSEFKHCWDTF

VDHQGCPFQPWDGLEEHSQALSGRLRAILQNQGN (italic: nucleic acid editing domain; underline: cytoplasmic localization signal)
Green Monkey APOBEC-3G:

(SEQ ID NO: 59)
MNPQIRNMVEQMEPDIFVYYFNNRPILSGRNTVWLCYEVKTKDPSGPPLD

ANIFQGKLYPEAKDHPEMKFLHWFRKWRQLHRDQEYEVTWYVSWSPCTRC

ANSVATFLAEDPKVTLTIFVARLYYFWKPDYQQALRILCQERGGPHATMK

IMNYNEFQHCWNEFVDGQGKPFKPRKNLPKHYTLLHATLGELLRHVMDPG

TFTSNFNNKPWVSGQRETYLCYKVERSHNDTWVLLNQHRGFLRNQAPDRH

GFPKGR*HAELCFLDLIPFWKLDDQQYRVTCFTSWSPCFSC*AQKMAKFISN

NKHVSLCIFAARIYDDQGRCQEGLRTLHRDGAKIAVMNYSEFEYCWDTFV

DRQGRPFQPWDGLDEHSQALSGRLRAI (italic: nucleic acid editing domain; underline: cytoplasmic localization signal)
Human APOBEC-3G:

(SEQ ID NO: 60)
MKPHFRNTVERMYRDTFSYNFYNRPILSRRNTVWLCYEVKTKGPSRPPLD

AKIFRGQVYSELKYHPEMRFFHWFSKWRKLHRDQEYEVTWYISWSPCTKC

TRDMATFLAEDPKVTLTIFVARLYYFWDPDYQEALRSLCQKRDGPRATMK

IMNYDEFQHCWSKFVYSQRELFEPWNNLPKYYILLHIMLGEILRHSMDPP

TFTFNFNNEPWVRGRHETYLCYEVERMHNDTWVLLNQRRGFLCNQAPHKH

GFLEGR*HAELCFLDVIPFWKLDLDQDYRVTCFTSWSPCFSC*AQEMAKFIS

KNKHVSLCIFTARIYDDQGRCQEGLRTLAEAGAKISIMTYSEFKHCWDTF

VDHQGCPFQPWDGLDEHSQDLSGRLRAILQNQEN (italic: nucleic acid editing domain; underline: cytoplasmic localization signal)
Human APOBEC-3F:

(SEQ ID NO: 61)
MKPHFRNTVERMYRDTFSYNFYNRPILSRRNTVWLCYEVKTKGPSRPRLD

AKIFRGQVYSQPEHH*HAEMCFLSWFCGNQLPAYKCFQITWFVSWTPCPDCV*

AKLAEFLAEHPNVTLTISAARLYYYWERDYRRALCRLSQAGARVKIMDDE

EFAYCWENFVYSEGQPFMPWYKFDDNYAFLHRTLKEILRNPMEAMYPHIF

YFHFKNLRKAYGRNESWLCFTMEVVKHHSPVSWKRGVFRNQVDPETHC*HA*

*ERCFLSWFCDDILSPNTNYEVTWYTSWSPCPEC*AGEVAEFLARHSNVNLT

IFTARLYYFWDTDYQEGLRSLSQEGASVEIMGYKDFKYCWENFVYNDDEP

FKPWKGLKYNFLFLDSKLQEILE (italic: nucleic acid editing domain)
Human APOBEC-3B:

(SEQ ID NO: 62)
MNPQIRNPMERMYRDTFYDNFENEPILYGRSYTWLCYEVKIKRGRSNLLW

DTGVFRGQVYFKPQY*HAEMCFLSWFCGNQLPAYKCFQITWFVSWTPCPDC*

VAKLAEFLSEHPNVTLTISAARLYYWERDYRRALCRLSQAGARVTIMDY

EEFAYCWENFVYNEGQQFMPWYKFDENYAFLHRTLKEILRYLMDPDTFTF

NFNNDPLVLRRRQTYLCYEVERLDNGTWVLMDQHMGFLCNEAKNLLCGFY

*GRHAELRFLDLVPSLQLDPAQIYRVTWFISWSPCFSWGC*AGEVRAFLQEN

THVRLRIFAARIYDYDPLYKEALQMLRDAGAQVSIMTYDEFEYCWDTFVY

RQGCPFQPWDGLEEHSQALSGRLRAILQNQGN (italic: nucleic acid editing domain)
Rat APOBEC-3B:

(SEQ ID NO: 63)
MQPQGLGPNAGMGPVCLGCSHRRPYSPIRNPLKKLYQQTFYFHFKNVRYA

WGRKNNFLCYEVNGMDCALPVPLRQGVFRKQGHIHAELCFIYWFHDKVLR

VLSPMEEFKVTWYMSWSPCSKCAEQVARFLAAHRNLSLAIFSSRLYYYLR

NPNYQQKLCRLIQEGVHVAAMDLPEFKKCWNKFVDNDGQPFRPWMRLRIN

FSFYDCKLQEIFSRMNLLREDVFYLQFNNSHRVKPVQNRYYRRKSYLCYQ

LERANGQEPLKGYLLYKKGEQHVEILFLEKMRSMELSQVRITCYLTWSPC

PNCARQLAAFKKDHPDLILRIYTSRLYFYWRKKFQKGLCTLWRSGIHVDV

MDLPQFADCWTNFVNPQRPFRPWNELEKNSWRIQRRLRRIKESWGL

Bovine APOBEC-3B:

(SEQ ID NO: 64)
DGWEVAFRSGTVLKAGVLGVSMTEGWAGSGHPGQGACVWTPGTRNTMNLL
REVLFKQQFGNQPRVPAPYYRRKTYLCYQLKQRNDLTLDRGCFRNKKQRH
AEIRFIDKINSLDLNPSQSYKIICYITWSPCPNCANELVNFITRNNHLKL
EIFASRLYFHWIKSFKMGLQDLQNAGISVAVMTHTEFEDCWEQFVDNQSR
PFQPWDKLEQYSASIRRRLQRILTAPI

Chimpanzee APOBEC-3B:

(SEQ ID NO: 65)
MNPQIRNPMEWMYQRTFYYNFENEPILYGRSYTWLCYEVKIRRGHSNLLW
DTGVFRGQMYSQPEHHAEMCFLSWFCGNQLSAYKCFQITWFVSWTPCPDC
VAKLAKFLAEHPNVTLTISAARLYYYWERDYRRALCRLSQAGARVKIMDD
EEFAYCWENFVYNEGQPFMPWYKFDDNYAFLHRTLKEIIRHLMDPDTFTF
NFNNDPLVLRRHQTYLCYEVERLDNGTWVLMDQHMGFLCNEAKNLLCGFY
GRHAELRFLDLVPSLQLDPAQIYRVTWFISWSPCFSWGCAGQVRAFLQEN
THVRLRIFAARIYDYDPLYKEALQMLRDAGAQVSIMTYDEFEYCWDTFVY
RQGCPFQPWDGLEEHSQALSGRLRAILQVRASSLCMVPHRPPPPQSPGP
CLPLCSEPPLGSLLPTGRPAPSLPFLLTASFSFPPPASLPPLPSLSLSPG
HLPVPSFHSLTSCSIQPPCSSRIRETEGWASVSKEGRDLG

Human APOBEC-3C:

(SEQ ID NO: 66)
MNPQIRNPMKAMYPGTFYFQFKNLWEANDRNETWLCFTVEGIKRRSVVSW
KTGVFRNQVDSETH*CHAERCFLSWFCDDILSPNTKYQVTWYTSWSPCPDC*
AGEVAEFLARHSNVNLTIFTARLYYFQYPCYQEGLRSLSQEGVAVEIMDY
EDFKYCWENFVYNDNEPFKPWKGLKTNFRLLKRRLRESLQ (italic: nucleic acid editing domain)
Gorilla APOBEC3C:

(SEQ ID NO: 67)
MNPQIRNPMKAMYPGTFYFQFKNLWEANDRNETWLCFTVEGIKRRSVVSW
KTGVFRNQVDSETH*CHAERCFLSWFCDDILSPNTNYQVTWYTSWSPCPEC*
AGEVAEFLARHSNVNLTIFTARLYYFQDTDYQEGLRSLSQEGVAVKIMDY
KDFKYCWENFVYNDDEPFKPWKGLKYNFRFLKRRLQEILE (italic: nucleic acid editing domain)
Human APOBEC-3A:

(SEQ ID NO: 68)
MEASPASGPRHLMDPHIFTSNFNNGIGRHKTYLCYEVERLDNGTSVKMDQ
HRGFLHNQAKNLLCGFYGR*HAELRFLDLVPSLQLDPAQIYRVTWFISWSP*
*CFSWGC*AGEVRAFLQENTHVRLRIFAARIYDYDPLYKEALQMLRDAGAQV
SIMTYDEFKHCWDTFVDHQGCPFQPWDGLEHSQALSGRLRAILQNQGN (italic: nucleic acid editing domain)
Rhesus Macaque APOBEC-3A:

(SEQ ID NO: 69)
MDGSPASRPRHLMDPNTFTFNFNNDLSVRGRHQTYLCYEVERLDNGTWVP
MDERRGFLCNKAKNVPCGDYGC*HVELRFLCEVPSWQLDPAQTYRVTWFIS*
*WSPC*FRRGCAGQVRVFLQENKHVRLRIFAARIYDYDPLYQEALRTLRDAG
AQVSIMTYEEFKHCWDTFVDRQGRPFQPWDGLDEHSQALSGRLRAILQNQ
GN (italic: nucleic acid editing domain)
Bovine APOBEC-3A:

(SEQ ID NO: 70)
MDEYTFTENFNNQGWPSKTYLCYEMERLDGDATIPLDEYKGFVRNKGLDQ
PEKPC*HAELYFLGKIHSWNLDRNQHYRLTCFISWSPC*YDCAQKLTTFLKE
NHHISLHILASRIYTHNRFGCHQSGLCELQAAGARITIMTFEDFKHCWET
FVDHKGKPFQPWEGLNVKSQALCTELQAILKTQQN (italic: nucleic acid editing domain)
Human APOBEC-3H:

(SEQ ID NO: 71)
MALLTAETFRLQFNNKRRLRRPYYPRKALLCYQLTPQNGSTPTRGYFENK
KKC*HAEICFINEIKSMGLDETQCYQVTCYLTWSPCSSC*AWELVDFIKAHD
HLNLGIFASRLYYHWCKPQQKGLRLLCGSQVPVEVMGFPKFADCWENFVD
HEKPLSFNPYKMLEELDKNSRAIKRRLERIKIPGVRAQGRYMDILCDAEV (italic: nucleic acid editing domain)
Rhesus Macaque APOBEC-3H:

(SEQ ID NO: 72)
MALLTAKTFSLQFNNKRRVNKPYYPRKALLCYQLTPQNGSTPTRGHLKNK
KKDHAEIRFINKIKSMGLDETQCYQVTCYLTWSPCPSCAGELVDFIKAHR
HLNLRIFASRLYYHWRPNYQEGLLLLCGSQVPVEVMGLPEFTDCWENFVD
HKEPPSFNPSEKLEELDKNSQAIKRRLERIKSRSVDVLENGLRSLQLGPV
TPSSSIRNSR

Human APOBEC-3D:

(SEQ ID NO: 73)
MNPQIRNPMERMYRDTFYDNFENEPILYGRSYTWLCYEVKIKRGRSNLLW
DTGVFRGPVLPKRQSNHRQEVYFRFEN*HAEMCFLSWFCGNRLPANRRFQI*
*TWFVSWNPCLPCVVKVTKFLAEHPNVTLTISAARLYYYRDRDWRWVLLRL
HKAGARVKIMDYEDFAYCWENFVCNEGQPFMPWYKFDDNYASLHRTLKEI
LRNPMEAMYPHIFYFHFKNLLKACGRNESWLCFTMEVTKHHSAVFRKRGV
FRNQVDPETHC*HAERCFLSWFCDDILSPNTNYEVTWYTSWSPCPEC*AGEV
AEFLARHSNVNLTIFTARLCYFWDTDYQEGLCSLSQEGASVKIMGYKDFV
SCWKNFVYSDDEPFKPWKGLQTNFRLLKRRLREILQ (italic: nucleic acid editing domain)
Human APOBEC-1:

(SEQ ID NO: 74)
MTSEKGPSTGDPTLRRRIEPWEFDVFYDPRELRKEACLLYEIKWGMSRKI
WRSSGKNTTNHVEVNFIKKFTSERDFHPSMSCSITWFLSWSPCWECSQAI
REFLSRHPGVTLVIYVARLFWHMDQQNRQGLRDLVNSGVTIQIMRASEYY
HCWRNFVNYPPGDEAHWPQYPPLWMMLYALELHCIILSLPPCLKISRRWQ
NHLTFFRLHLQNCHYQTIPPHILLATGLIHPSVAWR

Mouse APOBEC-1:

(SEQ ID NO: 75)
MSSETGPVAVDPTLRRRIEPHEFEVFFDPRELRKETCLLYEINWGGRHSV
WRHTSQNTSNHVEVNFLEKFTTERYFRPNTRCSITWFLSWSPCGECSRAI
TEFLSRHPYVTLFIYIARLYHHTDQRNRQGLRDLISSGVTIQIMTEQEYC
YCWRNFVNYPPSNEAYWPRYPHLWVKLYVLELYCIILGLPPCLKILRRKQ
PQLTFFTITLQTCHYQRIPPHLLWATGLK

Rat APOBEC-1:

(SEQ ID NO: 76)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLK

Human APOBEC-2:

(SEQ ID NO: 77)
MAQKEEAAVATEAASQNGEDLENLDDPEKLKELIELPPFEIVTGERLPAN
FFKFQFRNVEYSSGRNKTFLCYVVEAQGKGGQVQASRGYLEDEHAAAHAE
EAFFNTILPAFDPALRYNVTWYVSSSPCAACADRIIKTLSKTKNLRLLIL
VGRLFMWEEPEIQAALKKLKEAGCKLRIMKPQDFEYVWQNFVEQEEGESK
AFQPWEDIQENFLYYEEKLADILK

Mouse APOBEC-2:

(SEQ ID NO: 78)
MAQKEEAAEAAAPASQNGDDLENLEDPEKLKELIDLPPFEIVTGVRLPVN
FFKFQFRNVEYSSGRNKTFLCYVVEVQSKGGQAQATQGYLEDEHAGAHAE
EAFFNTILPAFDPALKYNVTWYVSSSPCAACADRILKTLSKTKNLRLLIL
VSRLFMWEEPEVQALKKLKEAGCKLRIMKPQDFEYIWQNFVEQEEGESK
AFEPWEDIQENFLYYEEKLADILK

Rat APOBEC-2:

(SEQ ID NO: 79)
MAQKEEAAEAAAPASQNGDDLENLEDPEKLKELIDLPPFEIVTGVRLPVN
FFKFQFRNVEYSSGRNKTFLCYVVEAQSKGGQVQATQGYLEDEHAGAHAE
EAFFNTILPAFDPALKYNVTWYVSSSPCAACADRILKTLSKTKNLRLLIL
VSRLFMWEEPEVQAALKKLKEAGCKLRIMKPQDFEYLWQNFVEQEEGESK
AFEPWEDIQENFLYYEEKLADILK

Bovine APOBEC-2:

(SEQ ID NO: 80)
MAQKEEAAAAAEPASQNGEEVENLEDPEKLKELIELPPFEIVTGERLPAH
YFKFQFRNVEYSSGRNKTFLCYVVEAQSKGGQVQASRGYLEDEHATNHAE
EAFFNSIMPTFDPALRYMVTWYVSSSPCAACADRIVKTLNKTKNLRLLIL
VGRLFMWEEPEIQAALRKLKEAGCRLRIMKPQDFEYIWQNFVEQEEGESK
AFEPWEDIQENFLYYEEKLADILK

*Petromyzon marinus* CDA1 (pmCDA1)

(SEQ ID NO: 81)
MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAV

Human APOBEC3G D316R_D317R (SEQ ID NO: 82)
MKPHFRNTVERMYRDTFSYNFYNRPILSRRNTVWLCYEVKTKGPSRPPLD
AKIFRGQVYSELKYHPEMRFFHWFSKWRKLHRDQEYEVTWYISWSPCTKC
TRDMATFLAEDPKVTLTIFVARLYYFWDPDYQEALRSLCQKRDGPRATMK
IMNYDEFQHCWSKFVYSQRELFEPWNNLPKYYILLHIMLGEILRHSMDPP
TFTFNFNNEPWVRGRHETYLCYEVERMHNDTWVLLNQRRGFLCNQAPHKH
GFLEGRHAELCFLDVIPFWKLDLDQDYRVTCFTSWSPCFSCAQEMAKFIS
KNKHVSLCIFTARIYRRQGRCQEGLRTLAEAGAKISMTYSEFKHCWDTF
VDHQGCPFQPWDGLDEHSQDLSGRLRAILQNQEN Human APOBEC3G chain A (SEQ ID NO: 83)
MDPPTFTFNFNNEPWVRGRHETYLCYEVERMHNDTWVLLNQRRGFLCNQA
PHKHGFLEGRHAELCFLDVIPFWKLDLDQDYRVTCFTSWSPCFSCAQEMA
KFISKNKHVSLCIFTARIYDDQGRCQEGLRTLAEAGAKISIMTYSEFKHC
WDTFVDHQGCPFQPWDGLDEHSQDLSGRLRAILQ Human APOBEC3G chain A D120R_D121R (SEQ ID NO: 84)
MDPPTFTFNFNNEPWVRGRHETYLCYEVERMHNDTWVLLNQRRGFLCNQA
PHKHGFLEGRHAELCFLDVIPFWKLDLDQDYRVTCFTSWSPCFSCAQEMA
KFISKNKHVSLCIFTARIYRRQGRCQEGLRTLAEAGAKISIMTYSEFKHC
WDTFVDHQGCPFQPWDGLDEHSQDLSGRLRAILQ In some embodiments, fusion proteins as provided herein comprise the full-length amino acid of a nucleic acid editing enzyme, e.g., one of the sequences provided above. In other embodiments, however, fusion proteins as provided herein do not comprise a full-length sequence of a nucleic acid editing enzyme, but only a fragment thereof. For example, in some embodiments, a fusion protein provided herein comprises a Cas9 domain and a fragment of a nucleic acid editing enzyme, e.g., wherein the fragment comprises a nucleic acid editing domain. Exemplary amino acid sequences of nucleic acid editing domains are shown in the sequences above as italicized letters, and additional suitable sequences of such domains will be apparent to those of skill in the art.

Additional suitable nucleic-acid editing enzyme sequences, e.g., deaminase enzyme and domain sequences, that can be used according to aspects of this invention, e.g., that can be fused to a nuclease-inactive Cas9 domain, will be apparent to those of skill in the art based on this disclosure. In some embodiments, such additional enzyme sequences include deaminase enzyme or deaminase domain sequences that are at least 70%, at least 75%, at least 80%, at least 85%, at least 90%, at least 95%, at least 96%, at least 97%, at least 98%, or at least 99% similar to the sequences provided herein. Additional suitable Cas9 domains, variants, and sequences will also be apparent to those of skill in the art. Examples of such additional suitable Cas9 domains include, but are not limited to, D10A, D10A/D839A/H840A, and D10A/D839A/H840A/N863A mutant domains (see, e.g., Prashant et al., CAS9 transcriptional activators for target specificity screening and paired nickases for cooperative genome engineering. Nature Biotechnology. 2013; 31(9): 833-838 the entire contents of which are incorporated herein by reference). In some embodiments, the Cas9 comprises a histidine residue at position 840 of the amino acid sequence provided in SEQ ID NO: 6, or a corresponding mutation in any Cas9 protein, such as any one of the Cas9 amino acid sequences as provided herein. The presence of the catalytic residue H840 restores the activity of the Cas9 to cleave the non-edited strand containing a G opposite the targeted C. Restoration of H840 does not result in the cleavage of the target strand containing the C.

Additional suitable strategies for generating fusion proteins comprising a Cas9 domain and a deaminase domain will be apparent to those of skill in the art based on this disclosure in combination with the general knowledge in the art. Suitable strategies for generating fusion proteins according to aspects of this disclosure using linkers or without the use of linkers will also be apparent to those of skill in the art in view of the instant disclosure and the knowledge in the art. For example, Gilbert et al., CRISPR-mediated modular RNA-guided regulation of transcription in eukaryotes. *Cell.* 2013; 154(2):442-51, showed that C-terminal fusions of Cas9 with VP64 using 2 NLS's as a linker (SPKKKRKVEAS, SEQ ID NO: 617), can be employed for transcriptional activation. Mali et al., CAS9 transcriptional activators for target specificity screening and paired nickases for cooperative genome engineering. *Nat Biotechnol.* 2013; 31(9):833-8, reported that C-terminal fusions with VP64 without linker can be employed for transcriptional activation. And Maeder et al., CRISPR RNA-guided activation of endogenous human genes. *Nat Methods.* 2013; 10: 977-979, reported that C-terminal fusions with VP64 using a Gly$_4$Ser (SEQ ID NO: 613) linker can be used as transcriptional activators. Recently, dCas9-FokI nuclease fusions have successfully been generated and exhibit improved enzymatic specificity as compared to the parental Cas9 enzyme (In Guilinger J P, Thompson D B, Liu D R. Fusion of catalytically inactive Cas9 to FokI nuclease improves the specificity of genome modification. *Nat. Biotechnol.* 2014; 32(6): 577-82, and in Tsai S Q, Wyvekens N, Khayter C, Foden J A, Thapar V, Reyon D, Goodwin M J, Aryee M J, Joung J K. Dimeric CRISPR RNA-guided FokI nucleases for highly specific genome editing. *Nat Biotechnol.* 2014; 32(6):569-76. PMID: 24770325 a SGSETPGTSESATPES (SEQ ID NO: 604) or a GGGGS (SEQ ID NO: 607) linker was used in FokI-dCas9 fusion proteins, respectively).

Some aspects of this disclosure provide fusion proteins comprising (i) a Cas9 enzyme or domain (e.g., a first protein); and (ii) a nucleic acid-editing enzyme or domain (e.g., a second protein). In some aspects, the fusion proteins provided herein further include (iii) a programmable DNA-binding protein, for example, a zinc-finger domain, a TALE, or a second Cas9 protein (e.g., a third protein). Without wishing to be bound by any particular theory, fusing a programmable DNA-binding protein (e.g., a second Cas9 protein) to a fusion protein comprising (i) a Cas9 enzyme or domain (e.g., a first protein); and (ii) a nucleic acid-editing enzyme or domain (e.g., a second protein) may be useful for improving specificity of the fusion protein to a target nucleic acid sequence, or for improving specificity or binding affinity of the fusion protein to bind target nucleic acid sequence that does not contain a canonical PAM (NGG) sequence. In some embodiments, the third protein is a Cas9 protein (e.g., a second Cas9 protein). In some embodiments, the third protein is any of the Cas9 proteins provided herein. In some embodiments, the third protein is fused to the fusion protein N-terminal to the Cas9 protein (e.g., the first protein). In some embodiments, the third protein is fused to the fusion protein C-terminal to the Cas9 protein (e.g., the first protein). In some embodiments, the Cas9 domain (e.g., the first protein) and the third protein (e.g., a second Cas9 protein) are fused via a linker (e.g., a second linker). In some embodiments, the linker comprises a (GGGGS)$_n$ (SEQ ID NO: 607), a (G)$_n$(SEQ ID NO: 608), an (EAAAK)$_n$ (SEQ ID NO: 609), a (GGS)$_n$(SEQ ID NO: 610), (SGGS)$_n$(SEQ ID NO: 606), a SGSETPGTSESATPES (SEQ ID NO: 604), a SGGS(GGS)$_n$ (SEQ ID NO: 612), a SGGSSGGSSG-SETPGTSESATPESSGGSSGGS (SEQ ID NO: 605), or an (XP)$_n$ (SEQ ID NO: 611) motif, or a combination of any of these, wherein n is independently an integer between 1 and 30. In some embodiments, the general architecture of exemplary napDNAbp fusion proteins provided herein comprises the structure:

[NH2]-[nucleic acid-editing enzyme or domain]-[napDNAbp]-[third protein]-[COOH];

[NH2]-[third protein]-[napDNAbp]-[nucleic acid-editing enzyme or domain]-[COOH];

[NH2]-[napDNAbp]-[nucleic acid-editing enzyme or domain]-[third protein]-[COOH];

[NH2]-[third protein]-[nucleic acid-editing enzyme or domain]-[napDNAbp]-[COOH];

[NH2]-[UGI]-[nucleic acid-editing enzyme or domain]-napDNAbp]-[third protein]-[COOH];

[NH2]-[UGI]-[third protein]-[napDNAbp]-[nucleic acid-editing enzyme or domain]-[COOH];

[NH2]-[UGI]-[napDNAbp]-[nucleic acid-editing enzyme or domain]-[third protein]-[COOH];

[NH2]-[UGI]-[third protein]-[nucleic acid-editing enzyme or domain]-[napDNAbp]-[COOH];

[NH2]-[nucleic acid-editing enzyme or domain]-[napDNAbp]-[third protein]-[UGI]-[COOH];

[NH2]-[third protein]-[napDNAbp]-[nucleic acid-editing enzyme or domain]-[UGI]-[COOH];

[NH2]-[NapDNAbp]-[nucleic acid-editing enzyme or domain]-[third protein]-[UGI]-[COOH];

[NH2]-[third protein]-[nucleic acid-editing enzyme or domain]-[NapDNAbp]-[UGI]-[COOH]; or

[NH2]-[nucleic acid-editing enzyme or domain]-[NapDNAbp]-[first UGI domain]-[second UGI domain]-[COOH];

wherein NH2 is the N-terminus of the fusion protein, and COOH is the C-terminus of the fusion protein. In some embodiments, the "]-[" used in the general architecture above indicates the presence of an optional linker sequence. In other examples, the general architecture of exemplary NapDNAbp fusion proteins provided herein comprises the structure:

[NH2]-[nucleic acid-editing enzyme or domain]-[NapDNAbp]-[second NapDNAbp protein]-[COOH];

[NH2]-[second NapDNAbp protein]-[NapDNAbp]-[nucleic acid-editing enzyme or domain]-[COOH];

[NH2]-[NapDNAbp]-[nucleic acid-editing enzyme or domain]-[second NapDNAbp protein]-[COOH];

[NH2]-[second NapDNAbp protein]-[nucleic acid-editing enzyme or domain]-[NapDNAbp]-[COOH];

[NH2]-[UGI]-[nucleic acid-editing enzyme or domain]-[NapDNAbp]-[second NapDNAbp protein]-[COOH],

[NH2]-[UGI]-[second NapDNAbp protein]-[NapDNAbp]-[nucleic acid-editing enzyme or domain]-[COOH];

[NH2]-[UGI]-[NapDNAbp]-[nucleic acid-editing enzyme or domain]-[second NapDNAbp protein]-[COOH];

[NH2]-[UGI]-[second NapDNAbp protein]-[nucleic acid-editing enzyme or domain]-[NapDNAbp]-[COOH];

[NH2]-[nucleic acid-editing enzyme or domain]-[NapDNAbp]-[second NapDNAbp protein]-[UGI]-[COOH];

[NH2]-[second NapDNAbp protein]-[NapDNAbp]-[nucleic acid-editing enzyme or domain]-[UGI]-[COOH];

[NH2]-[NapDNAbp]-[nucleic acid-editing enzyme or domain]-[second NapDNAbp protein]-[UGI]-[COOH]; or

[NH2]-[second NapDNAbp protein]-[nucleic acid-editing enzyme or domain]-[NapDNAbp]-[UGI]-[COOH];

wherein NH$_2$ is the N-terminus of the fusion protein, and COOH is the C-terminus of the fusion protein. In some embodiments, the "]-[" used in the general architecture above indicates the presence of an optional linker sequence. In some embodiments, the second NapDNAbp is a dCas9 protein. In some examples, the general architecture of exemplary Cas9 fusion proteins provided herein comprises a structure as shown in FIG. 3. It should be appreciated that any of the proteins provided in any of the general architectures of exemplary Cas9 fusion proteins may be connected by one or more of the linkers provided herein. In some embodiments, the linkers are the same. In some embodiments, the linkers are different. In some embodiments, one or more of the proteins provided in any of the general architectures of exemplary Cas9 fusion proteins are not fused via a linker. In some embodiments, the fusion proteins further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the third protein. In some embodiments, the NLS is fused to the C-terminus of the third protein. In some embodiments, the NLS is fused to the N-terminus of the Cas9 protein. In some embodiments, the NLS is fused to the C-terminus of the Cas9 protein. In some embodiments, the NLS is fused to the N-terminus of the nucleic acid-editing enzyme or domain. In some embodiments, the NLS is fused to the C-terminus of the nucleic acid-editing enzyme or domain. In some embodiments, the NLS is fused to the N-terminus of the UGI protein. In some embodiments, the NLS is fused to the C-terminus of the UGI protein. In some embodiments, the NLS is fused to the fusion protein via one or more linkers. In some embodiments, the NLS is fused to the fusion protein without a linker Uracil Glycosylase Inhibitor Fusion Proteins Some aspects of the disclosure relate to fusion proteins that comprise a uracil glycosylase inhibitor (UGI) domain. In some embodiments, any of the fusion proteins provided herein that comprise a Cas9 domain (e.g., a nuclease active Cas9 domain, a nuclease inactive dCas9 domain, or a Cas9 nickase) may be further fused to a UGI domain either directly or via a linker. Some aspects of this disclosure provide deaminase-dCas9 fusion proteins, deaminase-nuclease active Cas9 fusion proteins and deaminase-Cas9 nickase fusion proteins with increased nucleobase editing efficiency. Without wishing to be bound by any particular theory, cellular DNA-repair response to the presence of U:G heteroduplex DNA may be responsible for the decrease in nucleobase editing efficiency in cells. For example, uracil DNA glycosylase (UDG) catalyzes removal of U from DNA in cells, which may initiate base excision repair, with reversion of the U:G pair to a C:G pair as the most common outcome. As demonstrated in the Examples below, Uracil DNA Glycosylase Inhibitor (UGI) may inhibit human UDG activity. Thus, this disclosure contemplates a fusion protein comprising dCas9-nucleic acid editing domain further fused to a UGI domain. This disclosure also contemplates a fusion protein comprising a Cas9 nickase-nucleic acid editing domain further fused to a UGI domain. It should be understood that the use of a UGI domain may increase the editing efficiency of a nucleic acid editing domain that is capable of catalyzing a C to U change. For example, fusion proteins comprising a UGI domain may be more efficient in deaminating C residues. In some embodiments, the fusion protein comprises the structure:

[deaminase]-[optional linker sequence]-[dCas9]-[optional linker sequence]-[UGI];

[deaminase]-[optional linker sequence]-[UGI]-[optional linker sequence]-[dCas9];

[UGI]-[optional linker sequence]-[deaminase]-[optional linker sequence]-[dCas9];

[UGI]-[optional linker sequence]-[dCas9]-[optional linker sequence]-[deaminase];

[dCas9]-[optional linker sequence]-[deaminase]-[optional linker sequence]-[UGI];

[dCas9]-[optional linker sequence]-[UGI]-[optional linker sequence]-[deaminase];

[deaminase]-[optional linker sequence]-[dCas9]-[optional linker sequence]-[first UGI]-[optional linker sequence]-[second UGI];

[deaminase]-[optional linker sequence]-[first UGI]-[optional linker segeunce]-[second UGI]-[optional linker sequence]-[dCas9];

[first UGI]-[optional linker sequence]-[second UGI]-[optional linker sequence]-[deaminase]-[optional linker sequence]-[dCas9];

[first UGI]-[optional linker sequence]-[second UGi]-[optional linker sequence]-[dCas9]-[optional linker sequence]-[deaminase];

[dCas9]-[optional linker sequence]-[deaminase]-[optional linker sequence]-[first UGI]-[optional linker sequence]-[second UGI]; or

[dCas9]-[optional linker sequence]-[first UGI]-[optional linker sequence]-[second UGI]-[optional linker sequence]-[deaminase].

In other embodiments, the fusion protein comprises the structure:

[deaminase]-[optional linker sequence]-[Cas9 nickase]-[optional linker sequence]-[UGI];
[deaminase]-[optional linker sequence]-[UGI]-[optional linker sequence]-[Cas9 nickase];
[UGI]-[optional linker sequence]-[deaminase]-[optional linker sequence]-[Cas9 nickase];
[UGI]-[optional linker sequence]-[Cas9 nickase]-[optional linker sequence]-[deaminase];
[Cas9 nickase]-[optional linker sequence]-[deaminase]-[optional linker sequence]-[UGI];
[Cas9 nickase]-[optional linker sequence]-[UGI]-[optional linker sequence]-[deaminase]
[deaminase]-[optional linker sequence]-[Cas9 nickase]-[optional linker sequence]-[first UGI]-[optional linker sequence]-[second UGI];
[deaminase]-[optional linker sequence]-[first UGI]-[optional linker sequence]-[second UGI]-[optional linker sequence]-[Cas9 nickase];
[first UGI]-[optional linker sequence]-[second UGI]-[optional linker sequence]-[deaminase]-[optional linker sequence]-[Cas9 nickase];
[first UGI]-[optional linker sequence]-[second UGi]-[optional linker sequence]-[Cas9 nickase]-[optional linker sequence]-[deaminase];
[Cas9 nickase]-[optional linker sequence]-[deaminase]-[optional linker sequence]-[first UGI]-[optional linker sequence]-[second UGI]; or
[Cas9 nickase]-[optional linker sequence]-[first UGI]-[optional linker sequence]-[second UGI]-[optional linker sequence]-[deaminase].

It should be appreciated that any of the fusion proteins described above may be comprised of (i) a nucleic acid programmable DNA binding protein (napDNAbp); (ii) a cytidine deaminase domain; and (iii) two or more UGI domains, wherein the two or more UGI domains may be adjacent (e.g., [first UGI]-[second UGI], wherein "-" is an optional linker) to one another in the construct, or the two or more UGI domains may be separated by the napDNAbp of (i) and/or the cytidine deaminase domain of (ii) (e.g., [first UGI]-[deaminase]-[second UGI], [first UGI]-[napDNAbp]-[second UGI], [first UGI]-[deaminase]-[napDNAbp]-[second UGI], ect., wherein "-" is an optional linker).

In another aspect, the fusion protein comprises: (i) a Cas9 enzyme or domain; (ii) a nucleic acid-editing enzyme or domain (e.g., a second protein) (e.g., a cytidine deaminase domain); (iii) a first uracil glycosylase inhibitor domain (UGI) (e.g., a third protein); and (iv) a second uracil glycosylase inhibitor domain (UGI) (e.g., a fourth protein). The first and second uracil glycosylase inhibitor domains (UGIs) may be the same or different. In some embodiments, the Cas9 domain (e.g., the first protein) and the deaminase (e.g., the second protein) are fused via a linker. In some embodiments, the Cas9 domain is fused to the C-terminus of the deaminase. In some embodiments, the Cas9 protein (e.g., the first protein) and the first UGI domain (e.g., the third protein) are fused via a linker (e.g., a second linker). In some embodiments, the first UGI domain is fused to the C-terminus of the Cas9 protein. In some embodiments, the first UGI domain (e.g., the third protein) and the second UGI domain (e.g., the forth protein) are fused via a linker (e.g., a third linker). In some embodiments, the second UGI domain is fused to the C-terminus of the first UGI domain. In some embodiments, the linker comprises a (GGGGS)$_n$ (SEQ ID NO: 607), a (G)$_n$ (SEQ ID NO: 608), an (EAAAK)$_n$ (SEQ ID NO: 609), a (GGS)$_n$(SEQ ID NO: 610), (SGGS)$_n$(SEQ ID NO: 606), a SGSETPGTSESATPES (SEQ ID NO: 604), a SGGS(GGS)$_n$ (SEQ ID NO: 612), a SGGSSGGSSG-SETPGTSESATPESSGGSSGGS (SEQ ID NO: 605), or an (XP)$_n$ (SEQ ID NO: 611) motif, or a combination of any of these, wherein n is independently an integer between 1 and 30. In some embodiments, the first linker comprises an amino acid sequence of 1-50 amino acids. In some embodiments, the first linker comprises an amino acid sequence of 1-40 amino acids. In some embodiments, the first linker comprises an amino acid sequence of 1-35 amino acids. In some embodiments, the first linker comprises an amino acid sequence of 1-30 amino acids. In some embodiments, the first linker comprises an amino acid sequence of 1-20 amino acids. In some embodiments, the first linker comprises an amino acid sequence of 10-20 amino acids. In some embodiments, the first linker comprises an amino acid sequence of 30-40 amino acids. In some embodiments, the first linker comprises an amino acid sequence of 14, 16, or 18 amino acids. In some embodiments, the first linker comprises an amino acid sequence of 16 amino acids. In some embodiments, the first linker comprises an amino acid sequence of 30, 32, or 34 amino acids. In some embodiments, the first linker comprises an amino acid sequence of 32 amino acids. In some embodiments, the first linker comprises a SGSETPGTSESATPES (SEQ ID NO: 604) motif. In some embodiments, the first linker comprises a SGGSSGGSSG-SETPGTSESATPESSGGSSGGS (SEQ ID NO: 605) motif. In some embodiments, the second linker comprises an amino acid sequence of 1-50 amino acids. In some embodiments, the second linker comprises an amino acid sequence of 1-40 amino acids. In some embodiments, the second linker comprises an amino acid sequence of 1-35 amino acids. In some embodiments, the second linker comprises an amino acid sequence of 1-30 amino acids. In some embodiments, the second linker comprises an amino acid sequence of 1-20 amino acids. In some embodiments, the second linker comprises an amino acid sequence of 2-20 amino acids. In some embodiments, the second linker comprises an amino acid sequence of 2-10 amino acids. In some embodiments, the second linker comprises an amino acid sequence of 10-20 amino acids. In some embodiments, the second linker comprises an amino acid sequence of 2, 4, or 6 amino acids. In some embodiments, the second linker comprises an amino acid sequence of 7, 9, or 11 amino acids. In some embodiments, the second linker comprises an amino acid sequence of 14, 16, or 18 amino acids. In some embodiments, the second linker comprises an amino acid sequence of 4 amino acids. In some embodiments, the second linker comprises an amino acid sequence of 9 amino acids. In some embodiments, the second linker comprises an amino acid sequence of 16 amino acids. In some embodiments, the second linker comprises a (SGGS)$_n$(SEQ ID NO: 606) motif, wherein n is an integer between 1 and 30, inclusive. In some embodiments, the second linker comprises a (SGG-S)$_n$(SEQ ID NO: 606) motif, wherein n is 1. In some embodiments, the second linker comprises a SGGS(GGS)$_n$ (SEQ ID NO: 612) motif, wherein n is an integer between 1 and 30, inclusive. In some embodiments, the second linker comprises a SGGS(GGS)$_n$ (SEQ ID NO: 612) motif, wherein n is 2. In some embodiments, the third linker comprises an amino acid sequence of 1-50 amino acids. In some embodiments, the third linker comprises an amino acid sequence of 1-40 amino acids. In some embodiments, the third linker comprises an amino acid sequence of 1-35 amino acids. In some embodiments, the third linker comprises an amino acid sequence of 1-30 amino acids. In some embodiments, the third linker comprises an amino acid sequence of 1-20 amino acids. In some embodiments, the third linker comprises an amino acid sequence of 2-20 amino acids. In some embodiments, the third linker comprises an amino acid sequence of 2-10 amino acids. In some embodiments, the third linker comprises an amino acid sequence of 10-20 amino acids. In some embodiments, the third linker comprises an amino acid sequence of 2, 4, or 6 amino acids. In some embodiments, the third linker comprises an amino acid sequence of 7, 9, or 11 amino acids. In some embodiments, the third linker comprises an amino acid sequence of 14, 16, or 18 amino acids. In some embodiments, the third linker comprises an amino acid sequence of 4 amino acids. In some embodiments, the third linker comprises an amino acid sequence of 9 amino acids. In some embodiments, the third linker comprises an amino acid sequence of 16 amino acids. In some embodiments, the third linker comprises a (SGGS)$_n$ (SEQ ID NO: 606) motif, wherein n is an integer between 1 and 30, inclusive. In some embodiments, the third linker comprises a (SGGS)$_n$(SEQ ID NO: 606) motif, wherein n is 1. In some embodiments, the third linker comprises a SGGS(GGS)$_n$ (SEQ ID NO: 612) motif, wherein n is an integer between 1 and 30, inclusive. In some embodiments, the third linker comprises a SGGS (GGS)$_n$ (SEQ ID NO: 612) motif, wherein n is 2.

In some embodiments, the fusion protein comprises the structure:

[deaminase]-[optional linker sequence]-[dCas9]-[optional linker sequence]-[first UGI]-[optional linker sequence]-[second UGI];

[deaminase]-[optional linker sequence]-[Cas9 nickase]-[optional linker sequence]-[first UGI]-[optional linker sequence]-[second UGI]; or

[deaminase]-[optional linker sequence]-[Cas9]-[optional linker sequence]-[first UGI]-[optional linker sequence]-[second UGI].

In another aspect, the fusion protein comprises: (i) a Cas9 enzyme or domain; (ii) a nucleic acid-editing enzyme or domain (e.g., a second protein) (e.g., a cytidine deaminase domain); (iii) more than two uracil glycosylase inhibitor (UGI) domains.

In some embodiments, the fusion proteins provided herein do not comprise a linker sequence. In some embodiments, one or both of the optional linker sequences are present. In some embodiments, one, two, or three of the optional linker sequences are present.

In some embodiments, the "-" used in the general architecture above indicates the presence of an optional linker sequence. In some embodiments, the fusion proteins comprising a UGI further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the Cas9 protein. In some embodiments, the NLS is fused to the C-terminus of the Cas9 protein. In some embodiments, the NLS is fused to the N-terminus of the deaminase. In some embodiments, the NLS is fused to the C-terminus of the deaminase. In some embodiments, the NLS is fused to the N-terminus of the second Cas9. In some embodiments, the NLS is fused to the C-terminus of the second Cas9. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 614 or SEQ ID NO: 615.

In some embodiments, a UGI domain comprises a wild-type UGI or a UGI as set forth in SEQ ID NO: 134. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 134. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 134. In some embodiments, a UGI comprises an amino acid sequence homologous to the amino acid sequence set forth in SEQ ID NO: 134 or an amino acid sequence homologous to a fragment of the amino acid sequence set forth in SEQ ID NO: 134. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 134. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 134. In some embodiments, the UGI comprises the following amino acid sequence:

>sp|P14739|UNGI_BPPB2 Uracil-DNA Glycosylase Inhibitor (SEQ ID NO: 134)
MTNLSDIIEKETGKQLVIQESILMLPEEVEEVIGNKPESDILVHTAYDES

TDENVMLLTSDAPEYKPWALVIQDSNGENKIKML

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. J. Biol. Chem. 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. J. Biol. Chem. 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. Nucleic Acids Res. 26:4880-4887(1998); and Putnam et al., Protein mimicry of DNA from crystal structures of the uracil-DNA glycosylase inhibitor protein and its complex with *Escherichia coli* uracil-DNA glycosylase. J. Mol. Biol. 287:331-346(1999), the entire contents of each are incorporated herein by reference.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. Additionally, any proteins that block or inhibit base-excision repair as also within the scope of this disclosure. In some embodiments, the fusion proteins described herein comprise one UGI domain. In some embodiments, the fusion proteins described herein comprise more than one UGI domain. In some embodiments, the fusion proteins described herein comprise two UGI domains. In some embodiments, the fusion proteins described herein comprise more than two UGI domains. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 135). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 136). As another example, a uracil glycosylase inhibitor is a catalytically inactive UDG. In some embodiments, a catalytically inactive UDG comprises the amino acid sequence (SEQ ID NO: 137). It should be appreciated that other uracil glycosylase inhibitors would be apparent to the skilled artisan and are within the scope of this disclosure. In some embodiments, a uracil glycosylase inhibitor is a protein that is homologous to any one of SEQ ID NOs: 135-137 or 143-148. In some embodiments, a uracil glycosylase inhibitor is a protein that is at least 50% identical, at least 55% identical at least 60% identical, at least 65% identical, at least 70% identical, at least 75% identical, at least 80% identical at least 85% identical, at least 90% identical, at least 95% identical, at least 96% identical, at least 98% identical, at least 99% identical, or at least 99.5% identical to any one of SEQ ID NOs: 135-137 or 143-148.

*Erwinia tasmaniensis* SSB (Themostable Single-Stranded DNA Binding Protein)

(SEQ ID NO: 135)
MASRGVNKVILVGNLGQDPEVRYMPNGGAVANITLATSESWRDKQTGETK

EKTEWHRVVLFGKLAEVAGEYLRKGSQVYIEGALQTRKWTDQAGVEKYTT

EVVVNVGGTMQMLGGRSQGGGASAGGQNGGSNNGWGQPQQPQGGNQFSGG

AQQQARPQQQPQQNNAPANNEPPIDFDDDIP

UdgX (Binds to Uracil in DNA but does not Excise)

(SEQ ID NO: 136)
MAGAQDFVPHTADLAELAAAAGECRGCGLYRDATQAVFGAGGRSARIMMI

GEQPGDKEDLAGLPFVGPAGRLLDRALEAADIDRDALYVTNAVKHFKFTR

AAGGKRRIHKTPSRTEVVACRPWLIAEMTSVEPDVVVLLGATAAKALLGN

DFRVTQHRGEVLHVDDVPGDPALVATVHPSSLLRGPKEERESAFAGLVDD

LRVAADVRP

UDG (Catalytically Inactive Human UDG, Binds to Uracil in DNA but does not Excise)

(SEQ ID NO: 137)
MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQEPYHGPNQAHGLCFSVQRPVPPPPSLENIYKELSTDIEDFVHPGHGD

LSGWAKQGVLLLNAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL

Additional single-stranded DNA binding proteins that can be used as a UGI are shown below. It should be appreciated that other single-stranded binding proteins may be used as a UGI, for example those described in Dickey T H, Altschuler S E, Wuttke D S. Single-stranded DNA-binding proteins: multiple domains for multiple functions. Structure. 2013 Jul. 2; 21(7):1074-84.

doi: 10.1016/j.str.2013.05.013. Review.; Marceau A H. Functions of single-strand DNA-binding proteins in DNA replication, recombination, and repair. Methods Mol Biol. 2012; 922:1-21. doi:

10.1007/978-1-62703-032-8_1.; Mijakovic, Ivan, et al.; Bacterial single-stranded DNA-binding proteins are phosphorylated on tyrosine. Nucleic Acids Res 2006; 34 (5): 1588-1596. doi: 10.1093/nar/gkj514; Mumtsidu E, Makhov A M, Konarev P V, Svergun D I, Griffith J D, Tucker P A. Structural features of the single-stranded DNA-binding protein of Epstein-Barrvirus. J Struct Biol. 2008 February; 161(2):172-87. Epub 2007 Nov. 1; Nowak M, Olszewski M, Śpibida M, Kur J. Characterization of single-stranded DNA-binding proteins from the psychrophilic bacteria *Desulfotalea psychrophila, Flavobacterium psychrophilum, Psychrobacter arcticus, Psychrobacter cryohalolentis, Psychromonas ingrahamii, Psychroflexus torquis*, and

*Photobacterium profundum*. BMC Microbiol. 2014 Apr. 14; 14:91. doi: 10.1186/1471-2180-14-91; Tone T, Takeuchi A, Makino O. Single-stranded DNA binding protein Gp5 of *Bacillus subtilis* phage Φ29 is required for viral DNA replication in growth-temperature dependent fashion. Biosci Biotechnol Biochem. 2012; 76(12):2351-3. Epub 2012 Dec. 7; Wold. REPLICATION PROTEIN A: A Heterotrimeric, Single-Stranded DNA-Binding Protein Required for Eukaryotic DNA Metabolism. Annual Review of Biochem. 1997; 66:61-92. doi: 10.1146/annurev.biochem.66.1.61; Wu Y, Lu J, Kang T. Human single-stranded DNA binding proteins: guardians of genome stability. Acta Biochim Biophys Sin (Shanghai). 2016 July; 48(7):671-7. doi: 10.1093/abbs/gmw044. Epub 2016 May 23. Review; the entire contents of each are hereby incorporated by reference.

mtSSB—SSBP1 Single Stranded DNA Binding Protein 1 [*Homo sapiens* (Human)](UniProtKB: Q04837; NP 001243439.1)

(SEQ ID NO: 138)
MFRRPVLQVLRQFVRHESETTTSLVLERSLNRVHLLGRVGQDPVLRQVEG

KNPVTIFSLATNEMWRSGDSEVYQLGDVSQKTTWHRISVFRPGLRDVAYQ

YVKKGSRIYLEGKIDYGEYMDKNNVRRQATTIIADNIIFLSDQTKEKE

Single-Stranded DNA-Binding Protein 3 Isoform A [*Mus musculus*] (UniProtKB—Q9D032-1; NCBI Ref: NP_076161.2)

(SEQ ID NO: 139)
MFAKGKGSAVPSDGQAREKLALYVYEYLLHVGAQKSAQTFLSEIRWEKNI

TLGEPPGFLHSWWCVFWDLYCAAPERRDTCEHSSEAKAFHDYSAAAAPSP

VLGNIPPNDGMPGGPIPPGFFQGPPGSQPSPHAQPPPHNPSSMMGPHSQP

FMSPRYAGGPRPPIRMGNQPPGGVPGTQPLLPNSMDPTRQQGHPNMGGSM

QRMNPPRGMGPMGPGPQNYGSGMRPPPNSLGPAMPGINMGPGAGRPWPNP

NSANSIPYSSSSPGTYVGPPGGGPPGTPIMPSPADSTNSSDNIYTMINP

VPPGGSRSNFPMGPGSDGPMGGMGGMEPHHMNGSLGSGDIDGLPKNSPNN

ISGISNPPGTPRDDGELGGNFLHSFQNDNYSPSMTMSV

RPA 1—Replication Protein A 70 kDa DNA-Binding Subunit (UniProtKB: P27694; NCBI Ref: NM 002945.3)

(SEQ ID NO: 140)
MVGQLSEGAIAAIMQKGDTNIKPILQVINIRPITTGNSPPRYRLLMSDGL

NTLSSFMLATQLNPLVEEEQLSSNCVCQIHRFIVNTLKDGRRVVILMELE

VLKSAEAVGVKIGNPVPYNEGLGQPQVAPPAPAASPAASSRPQPQNGSSG

MGSTVSKAYGASKTFGKAAGPSLSHTSGGTQSKVVPIASLTPYQSKWTIC

ARVTNKSQIRTWSNSRGEGKLFSLELVDESGEIRATAFNEQVDKFFPLIE

VNKVYYFSKGTLKIANKQFTAVKNDYEMTFNNETSVMPCEDDHHLPTVQF

DFTGIDDLENKSKDSLVDIIGICKSYEDATKITVRSNNREVAKRNIYLMD

TSGKVVTATLWGEDADKFDGSRQPVLAIKGARVSDFGGRSLSVLSSSTII

ANPDIPEAYKLRGWFDAEGQALDGVSISDLKSGGVGGSNTNWKTLYEVKS

ENLGQGDKPDYFSSVATVVYLRKENCMYQACPTQDCNKKVIDQQNGLYRC

EKCDTEFPNFKYRMILSVNIADFQENQWVTCFQESAEAILGQNAAYLGEL

KDKNEQAFEEVFQNANFRSFIFRVRVKVETYNDESRIKATVMDVKPVDYR

EYGRRLVMSIRRSALM

RPA 2—Replication Protein A 32 kDa Subunit (UniProtKB: P15927; NCBI Ref: NM_002946)

(SEQ ID NO: 141)
MWNSGFESYGSSSYGGAGGYTQSPGGFGSPAPSQAEKKSRARAQHIVPCT

ISQLLSATLVDEVFRIGNVEISQVTIVGIIRHAEKAPTNIVYKIDDMTAA

PMDVRQWVDTDDTSSENTVVPPETYVKVAGHLRSFQNKKSLVAFKIMPLE

DMNEFTTHILEVINAHMVLSKANSQPSAGRAPISNPGMSEAGNFGGNSFM

PANGLTVAQNQVLNLIKACPRPEGLNFQDLKNQLKHMSVSSIKQAVDFLS

NEGHIYSTVDDDHFKSTDAE

RPA 3—Replication Protein A 14 kDa Subunit (UniProtKB: P35244; NCBI Ref: NM_002947.4)

(SEQ ID NO: 142)
MVDMMDLPRSRINAGMLAQFIDKPVCFVGRLEKIHPTGKMFILSDGEGKN

GTIELMEPLDEEISGIVEVVGRVTAKATILCTSYVQFKEDSHPFDLGLYN

EAVKIIHDFPQFYPLGIVQHD

Bacterial Single-Stranded DNA-Binding Proteins:
ssbA—Single-Stranded DNA-Binding Protein [*Bacillus subtilis* Subsp. *Subtilis* Str. 168](UniProtKB: P37455; NCBI Ref:)

(SEQ ID NO: 143)
MLNRVVLVGRLTKDPELRYTPNGAAVATFTLAVNRTFTNQSGEREADFIN

CVTWRRQAENVANFLKKGSLAGVDGRLQTRNYENQQGQRVFVTEVQAESV

QFLEPKNGGGSGSGGYNEGNSGGGQYFGGGQNDNPFGGNQNNQRRNQGNS

FNDDPFANDGKPIDISDDDLPF

Single-Stranded DNA-Binding Protein 2 [*Streptomyces coelicolor* A3(2)] (UniProtKB: Q9X8U3; NCBI Ref: NP_628093.1)

(SEQ ID NO: 144)
MAGETVITVVGNLVDDPELRFTPSGAAVAKFRVASTPRTFDRQTNEWKDG

ESLFLTCSVWRQAAENVAESLQRGMRVIVQGRLKQRSYEDREGVKRTVYE

LDVDEVGASLRSATAKVTKTSGQGRGGQGGYGGGGGQGGGGWGGGPGGG

QQGGGAPADDPWATGGAPAGGQQGGGGQGGGGWGGGSGGGGYSDEPPF

Single-Stranded DNA-Binding Protein [*Streptococcus pneumoniae* R6] (UniProtKB: P66855; NCBI Ref: NP_358988.1)

(SEQ ID NO: 145)
MINNVVLVGRMTRDAELRYTPSNVAVATFTLAVNRTFKSQNGEREADFIN

VVMWRQQAENLANWAKKGSLIGVTGRIQTRSYDNQQGQRVYVTEVVAENF

QMLESRSVREGHTGGAYSAPTANYSAPTNSVPDFSRNENPFGATNPLDIS

DDDLPF

Viral Single-Stranded DNA-Binding Proteins:
Single-Stranded DNA-Binding Protein [Human Alphaherpesvirus 1] (UniProtKB: P04296; NCBI Ref: YP_009137104.1)

(SEQ ID NO: 146)
METKPKTATTIKVPPGPLGYVYARACPSEGIELLALLSARSGDSDVAVAP

LVVGLTVESGFEANVAVVVGSRTTGLGGTAVSLKLTPSHYSSSVYVFHGG

RHLDPSTQAPNLTRLCERARRHFGFSDYTPRPGDLKHETTGEALCERLGL

DPDRALLYLVVTEGFKEAVCINNTFLHLGGSDKVTIGGAEVHRIPVYPLQ

LFMPDFSRVIAEPFNANHRSIGENFTYPLPFFNRPLNRLLFEAVVGPAAV

ALRCRNVDAVARAAAHLAFDENHEGAALPADITFTAFEASQGKTPRGGRD

-continued

GGGKGPAGGFEQRLASVMAGDAALALESIVSMAVFDEPPTDISAWPLFEG

QDTAAARANAVGAYLARAAGLVGAMVFSTNSALHLTEVDDAGPADPKDHS

KPSFYRFFLVPGTHVAANPQVDREGHVVPGFEGRPTAPLVGGTQEFAGEH

LAMLCGFSPALLAKMLFYLERCDGGVIVGRQEMDVFRYVADSNQTDVPCN

LCTFDTRHACVHTTLMRLRARHPKFASAARGAIGVFGTMNSMYSDCDVLG

NYAAFSALKRADGSETARTIMQETYRAATERVMAELETLQYVDQAVPTAM

GRLETIITNREALHTVVNNVRQVVDREVEQLMRNLVEGRNFKFRDGLGEA

NHAMSLTLDPYACGPCPLLQLLGRRSNLAVYQDLALSQCHGVFAGQSVEG

RNFRNQFQPVLRRRVMDMFNNGFLSAKTLTVALSEGAAICAPSLTAGQTA

PAESSFEGDVARVTLGFPKELRVKSRVLFAGASANASEAAKARVASLQSA

YQKPDKRVDILLGPLGFLLKQFHAAIFPNGKPPGSNQPNPQWFWTALQRN

QLPARLLSREDIETIAFIKKFSLDYGAINFINLAPNNVSELAMYYMANQI

LRYCDHSTYFINTLTAIIAGSRRPPSVQAAAAWSAQGGAGLEAGARALMD

AVDAHPGAWTSMFASCNLLRPVMAARPMVVLGLSISKYYGMAGNDRVFQA

GNWASLMGGKNACPLLIFDRTRKFVLACPRAGFVCAASSLGGGAHESSLC

EQLRGIISEGGAAVASSVFVATVKSLGPRTQQLQIEDWLALLEDEYLSEE

MMELTARALERGNGEWSTDAALEVAHEAEALVSQLGNAGEVFNFGDFGCE

DDNATPFGGPGAPGPAFAGRKRAFHGDDPFGEGPPDKKGDLTLDML

Single-Stranded DNA-Binding Protein from *Bacillus* Virus Phi29 (UniProtKB: Q38504.1; NCBI Ref: YP_002004532.1)

(SEQ ID NO: 147)
MENTNIVKATFDTETLEGQIKIFNAQTGGGQSFKNLPDGTIIEANAIAQY

KQVSDTYGDAKEETVTTIFAADGSLYSAISKTVAEAASDLIDLVTRHKLE

TFKVKVVQGTSSKGNVFFSLQLSL

Single Stranded DNA Binding Protein [*Burkholderia* Virus DC1] (UniProtKB: I6NRL7; NCBI Ref: YP_006589943.1)

(SEQ ID NO: 148)
MASVNKVILVGNLGADPETRYLPSGDAISNIRLATTDRYKDKASGEMKES

TEWHRVSFFGRLAEIVDEYLRKGAPVYIEGRIRTRKWQDNAGQDRYTTEI

VAEKMQMLGDRRDGGERQQRAPQQQQQRTQRNGYADATGRAQPSQRPAAG

GGFDEMDDDIPF

In some embodiments, the nucleic acid editing domain is a deaminase domain. In some embodiments, the deaminase is a cytosine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deminase is a rat APOBEC1 (SEQ ID NO: 74). In some embodiments, the deminase is a human APOBEC1 (SEQ ID No: 76). In some embodiments, the deaminase is a *Petromyzon marinus* cytidine deaminase 1 (pmCDA1). In some embodiments, the deaminase is a human APOBEC3G (SEQ ID NO: 60). In some embodiments, the deaminase is a fragment of the human APOBEC3G (SEQ ID NO: 83). In some embodiments, the deaminase is a human APOBEC3G variant comprising a D316R_D317R mutation (SEQ ID NO: 82). In some embodiments, the deaminase is a fragment of the human APOBEC3G and comprising mutations corresponding to the D316R_D317R mutations in SEQ ID NO: 60 (SEQ ID NO: 84).

In some embodiments, the linker comprises a $(GGGS)_n$ (SEQ ID NO: 613), $(GGGGS)_n$ (SEQ ID NO: 607), a $(G)_n$ (SEQ ID NO: 608), an $(EAAAK)_n$ (SEQ ID NO: 609), a $(GGS)_n$ (SEQ ID NO: 610), an SGSETPGTSESATPES (SEQ ID NO: 604), or an $(XP)_n$ (SEQ ID NO: 611) motif, or a combination of any of these, wherein n is independently an integer between 1 and 30.

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264:1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), the entire contents of which are incorporated herein by reference. In some embodiments, the optional linker comprises a $(GGS)_n$ (SEQ ID NO: 610) motif, wherein n is 1, 2, 3, 4, 5, 6, 7, 8, 9, 19, 11, 12, 13, 14, 15, 16, 17, 18, 19, or 20. In some embodiments, the optional linker comprises a $(GGS)_n$ (SEQ ID NO: 610) motif, wherein n is 1, 3, or 7. In some embodiments, the optional linker comprises the amino acid sequence SGSETPGTSESATPES (SEQ ID NO: 604), which is also referred to as the XTEN linker in the Examples.

In some embodiments, a Cas9 nickase may further facilitate the removal of a base on the non-edited strand in an organism whose genome is edited in vivo. The Cas9 nickase, as described herein, may comprise a D10A mutation in SEQ ID NO: 6, or a corresponding mutation in any Cas9 protein, such as any one of the Cas9 amino acid sequences as provided herein. In some embodiments, the Cas9 nickase of this disclosure may comprise a histidine at mutation 840 of SEQ ID NO: 6, or a corresponding residue in any Cas9 protein, such as any one of the Cas9 amino acid sequences as provided herein. Such fusion proteins comprising the Cas9 nickase, can cleave a single strand of the target DNA sequence, e.g., the strand that is not being edited. Without wishing to be bound by any particular theory, this cleavage may inhibit mis-match repair mechanisms that reverse a C to U edit made by the deaminase.

Cas9 Complexes with Guide RNAs

Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide RNA is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide RNA is complementary to a sequence associated with a disease or disorder.

Methods of Using Cas9 Fusion Proteins

Some aspects of this disclosure provide methods of using the Cas9 proteins, fusion proteins, or complexes provided herein. For example, some aspects of this disclosure provide methods comprising contacting a DNA molecule (a) with any of the Cas9 proteins or fusion proteins provided herein, and with at least one guide RNA, wherein the guide RNA is about 15-100 nucleotides long and comprises a sequence of at least 10 contiguous nucleotides that is complementary to a target sequence; or (b) with a Cas9 protein, a Cas9 fusion protein, or a Cas9 protein or fusion protein complex with at least one gRNA as provided herein. In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the Cas9 protein, the Cas9 fusion protein, or the complex results in a correction of the point mutation. In some embodiments, the target DNA sequence comprises a T→C point mutation associated with a disease or disorder, and wherein the deamination of the mutant C base results in a sequence that is not associated with a disease or disorder. In some embodiments, the target DNA sequence encodes a protein and wherein the point mutation is in a codon and results in a change in the amino acid encoded by the mutant codon as compared to the wild-type codon. In some embodiments, the deamination of the mutant C results in a change of the amino acid encoded by the mutant codon. In some embodiments, the deamination of the mutant C results in the codon encoding the wild-type amino acid. In some embodiments, the contacting is in vivo in a subject. In some embodiments, the subject has or has been diagnosed with a disease or disorder. In some embodiments, the disease or disorder is cystic fibrosis, phenylketonuria, epidermolytic hyperkeratosis (EHK), Charcot-Marie-Toot disease type 4J, neuroblastoma (NB), von Willebrand disease (vWD), myotonia congenital, hereditary renal amyloidosis, dilated cardiomyopathy (DCM), hereditary lymphedema, familial Alzheimer's disease, HIV, Prion disease, chronic infantile neurologic cutaneous articular syndrome (CINCA), desmin-related myopathy (DRM), a neoplastic disease associated with a mutant PI3KCA protein, a mutant CTNNB1 protein, a mutant HRAS protein, or a mutant p53 protein.

Some embodiments provide methods for using the Cas9 DNA editing fusion proteins provided herein. In some embodiments, the fusion protein is used to introduce a point mutation into a nucleic acid by deaminating a target nucleobase, e.g., a C residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a Cas9 DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provide herein is to restore the function of a dysfunctional gene via genome editing. The Cas9 deaminase fusion proteins provided herein can be validated for gene editing-based human therapeutics in vitro, e.g., by correcting a disease-associated mutation in human cell culture. It will be understood by the skilled artisan that the fusion proteins provided herein, e.g., the fusion proteins comprising a Cas9 domain and a nucleic acid deaminase domain can be used to correct any single point T→C or A→G mutation. In the first case, deamination of the mutant C back to U corrects the mutation, and in the latter case, deamination of the C that is base-paired with the mutant G, followed by a round of replication, corrects the mutation.

An exemplary disease-relevant mutation that can be corrected by the provided fusion proteins in vitro or in vivo is the H1047R (A3140G) polymorphism in the PI3KCA protein. The phosphoinositide-3-kinase, catalytic alpha subunit (PI3KCA) protein acts to phosphorylate the 3-OH group of the inositol ring of phosphatidylinositol. The PI3KCA gene has been found to be mutated in many different carcinomas, and thus it is considered to be a potent oncogene.[37] In fact, the A3140G mutation is present in several NCI-60 cancer cell lines, such as, for example, the HCT116, SKOV3, and T47D cell lines, which are readily available from the American Type Culture Collection (ATCC).[38]

In some embodiments, a cell carrying a mutation to be corrected, e.g., a cell carrying a point mutation, e.g., an A3140G point mutation in exon 20 of the PI3KCA gene, resulting in a H1047R substitution in the PI3KCA protein, is contacted with an expression construct encoding a Cas9 deaminase fusion protein and an appropriately designed sgRNA targeting the fusion protein to the respective mutation site in the encoding PI3KCA gene. Control experiments can be performed where the sgRNAs are designed to target the fusion enzymes to non-C residues that are within the PI3KCA gene. Genomic DNA of the treated cells can be extracted, and the relevant sequence of the PI3KCA genes PCR amplified and sequenced to assess the activities of the fusion proteins in human cell culture.

It will be understood that the example of correcting point mutations in PI3KCA is provided for illustration purposes and is not meant to limit the instant disclosure. The skilled artisan will understand that the instantly disclosed DNA-editing fusion proteins can be used to correct other point mutations and mutations associated with other cancers and with diseases other than cancer including other proliferative diseases.

The successful correction of point mutations in disease-associated genes and alleles opens up new strategies for gene correction with applications in therapeutics and basic research. Site-specific single-base modification systems like the disclosed fusions of Cas9 and deaminase enzymes or domains also have applications in "reverse" gene therapy, where certain gene functions are purposely suppressed or abolished. In these cases, site-specifically mutating Trp (TGG), Gln (CAA and CAG), or Arg (CGA) residues to premature stop codons (TAA, TAG, TGA) can be used to abolish protein function in vitro, ex vivo, or in vivo.

The instant disclosure provides methods for the treatment of a subject diagnosed with a disease associated with or caused by a point mutation that can be corrected by a Cas9 DNA editing fusion protein provided herein. For example, in some embodiments, a method is provided that comprises administering to a subject having such a disease, e.g., a cancer associated with a PI3KCA point mutation as described above, an effective amount of a Cas9 deaminase fusion protein that corrects the point mutation or introduces a deactivating mutation into the disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation, cystic fibrosis (see, e.g., Schwank et al., Functional repair of CFTR by CRISPR/Cas9 in intestinal stem cell organoids of cystic fibrosis patients. *Cell stem cell.* 2013; 13: 653-658; and Wu et. al., Correction of a genetic disease in mouse via use of CRISPR-Cas9. *Cell stem cell.* 2013; 13: 659-662, neither of which uses a deaminase fusion protein to correct the genetic defect); phenylketonuria—e.g., phenylalanine to serine mutation at position 835 (mouse) or 240 (human) or a homologous residue in phenylalanine hydroxylase gene (T>C mutation)—see, e.g., McDonald et al., *Genomics.* 1997; 39:402-405; Bernard-Soulier syndrome (BSS)—e.g., phenylalanine to serine mutation at position 55 or a homologous residue, or cysteine to arginine at residue 24 or a homologous residue in the platelet membrane glycoprotein IX (T>C mutation)—see, e.g., Noris et al., *British Journal of Haematology.* 1997; 97: 312-320, and Ali et al., *Hematol.* 2014; 93: 381-384; epidermolytic hyperkeratosis (EHK)—e.g., leucine to proline mutation at position 160 or 161 (if counting the initiator methionine) or a homologous residue in keratin 1 (T>C mutation)—see, e.g., Chipev et al., *Cell.* 1992; 70: 821-828, see also accession number P04264 in the UNIPROT database at www[dot]uniprot[dot]org; chronic obstructive pulmonary disease (COPD)—e.g., leucine to proline mutation at position 54 or 55 (if counting the initiator methionine) or a homologous residue in the processed form of $\alpha_1$-antitrypsin or residue 78 in the unprocessed form or a homologous residue (T>C mutation) —see, e.g., Poller et al., *Genomics.* 1993; 17: 740-743, see also accession number P01011 in the UNIPROT database; Charcot-Marie-Toot disease type 4J—e.g., isoleucine to threonine mutation at position 41 or a homologous residue in FIG. 4 (T>C mutation)—see, e.g., Lenk et al., PLoS Genetics. 2011; 7: e1002104; neuroblastoma (NB)—e.g., leucine to proline mutation at position 197 or a homologous residue in Caspase-9 (T>C mutation)—see, e.g., Kundu et al., 3 *Biotech.* 2013, 3:225-234; von Willebrand disease (vWD)—e.g., cysteine to arginine mutation at position 509 or a homologous residue in the processed form of von Willebrand factor, or at position 1272 or a homologous residue in the unprocessed form of von Willebrand factor (T>C mutation)—see, e.g., Lavergne et al., *Br. J. Haematol.* 1992, see also accession number P04275 in the UNIPROT database; 82: 66-72; myotonia congenital—e.g., cysteine to arginine mutation at position 277 or a homologous residue in the muscle chloride channel gene CLCN1 (T>C mutation)—see, e.g., Weinberger et al., *The J. of Physiology.* 2012; 590: 3449-3464; hereditary renal amyloidosis—e.g., stop codon to arginine mutation at position 78 or a homologous residue in the processed form of apolipoprotein AII or at position 101 or a homologous residue in the unprocessed form (T>C mutation)—see, e.g., Yazaki et al., *Kidney Int.* 2003; 64: 11-16; dilated cardiomyopathy (DCM)—e.g., tryptophan to Arginine mutation at position 148 or a homologous residue in the FOXD4 gene (T>C mutation), see, e.g., Minoretti et. al., *Int. J. of Mol. Med.* 2007; 19: 369-372; hereditary lymphedema—e.g., histidine to arginine mutation at position 1035 or a homologous residue in VEGFR3 tyrosine kinase (A>G mutation), see, e.g., Irrthum et al., *Am. J. Hum. Genet.* 2000; 67: 295-301; familial Alzheimer's disease—e.g., isoleucine to valine mutation at position 143 or a homologous residue in presenilin1 (A>G mutation), see, e.g., Gallo et. al., *J. Alzheimer's disease.* 2011; 25: 425-431; Prion disease—e.g., methionine to valine mutation at position 129 or a homologous residue in prion protein (A>G mutation)—see, e.g., Lewis et. al., *J. of General Virology.* 2006; 87: 2443-2449; chronic infantile neurologic cutaneous articular syndrome (CINCA)—e.g., Tyrosine to Cysteine mutation at position 570 or a homologous residue in cryopyrin (A>G mutation)—see, e.g., Fujisawa et. al. *Blood.* 2007; 109: 2903-2911; and desmin-related myopathy (DRM)—e.g., arginine to glycine mutation at position 120 or a homologous residue in $\alpha\beta$ crystallin (A>G mutation)—see, e.g., Kumar et al., *J. Biol. Chem.* 1999; 274: 24137-24141.

The entire contents of all references and database entries is incorporated herein by reference.

It will be apparent to those of skill in the art that in order to target a Cas9:nucleic acid editing enzyme/domain fusion protein as disclosed herein to a target site, e.g., a site comprising a point mutation to be edited, it is typically necessary to co-express the Cas9:nucleic acid editing enzyme/domain fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcuagaaauagcaaguuaaaauaaggcuagu-ccguuaucaacuugaaaaaguggcaccgagucggugcuuuu u-3' (SEQ ID NO: 618), wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting Cas9:nucleic acid editing enzyme/domain fusion proteins to specific target sequences are provided below.

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a cytosine (C) to thymine (T) point mutation associated with a disease or disorder. In some embodiments, the intended mutation is a guanine (G) to adenine (A) point mutation associated with a disease or disorder. In some embodiments, the intended mutation is a cytosine (C) to thymine (T) point mutation within the coding region of a gene. In some embodiments, the intended mutation is a guanine (G) to adenine (A) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to a cytidine deaminase domain) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase; and the method results in less than 20% indel formation in the nucleic acid. It should be appreciated that in some embodiments, step b is omitted. In some embodiments, the first nucleobase is a cytosine. In some embodiments, the second nucleobase is a deaminated cytosine, or a uracil. In some embodiments, the third nucleobase is a guanine. In some embodiments, the fourth nucleobase is an adenine. In some embodiments, the first nucleobase is a cytosine, the second nucleobase is a deaminated cytosine, or a uracil, the third nucleobase is a guanine, and the fourth nucleobase is an adenine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., C:G→T:A). In some embodiments, the fifth nucleobase is a thymine. In some embodiments, at least 5% of the intended basepairs are edited. In some embodiments, at least 10%, 15%, 20%, 25%, 30%, 35%, 40%, 45%, or 50% of the intended basepairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is cytosine, and the second base is not a G, C, A, or T. In some embodiments, the second base is uracil. In some embodiments, the first base is cytosine. In some embodiments, the second base is not a G, C, A, or T. In some embodiments, the second base is uracil. In some embodiments, the base editor inhibits base escission repair of the edited strand. In some embodiments, the base editor protects or binds the non-edited strand. In some embodiments, the base editor comprises UGI activity. In some embodiments, the base editor comprises nickase activity. In some embodiments, the intended edited basepair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited basepair, wherein the efficiency of generating the intended edited basepair is at least 5%. It should be appreciated that in some embodiments, step b is omitted. In some embodiments, at least 5% of the intended basepairs are edited. In some embodiments, at least 10%, 15%, 20%, 25%, 30%, 35%, 40%, 45%, or 50% of the intended basepairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is cytosine. In some embodiments, the second nucleobase is not G, C, A, or T. In some embodiments, the second base is uracil. In some embodiments, the base editor inhibits base escission repair of the edited strand. In some embodiments, the base editor protects or binds the non-edited strand. In some embodiments, the nucleobase editor comprises UGI activity. In some embodiments, the nucleobase edit comprises nickase activity. In some embodiments, the intended edited basepair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions may optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with a any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. *Remington's The Science and Practice of Pharmacy*, 21$^{st}$ Edition, A. R. Gennaro (Lippincott, Williams & Wilkins, Baltimore, Md., 2006; incorporated in its entirety herein by reference) discloses various excipients used in formulating pharmaceutical compositions and known techniques for the preparation thereof. See also PCT application PCT/US2010/055131 (Publication number WO2011053982 A8, filed Nov. 2, 2010), incorporated in its entirety herein by reference, for additional suitable methods, reagents, excipients and solvents for producing pharmaceutical compositions comprising a nuclease. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

In some embodiments, compositions in accordance with the present invention may be used for treatment of any of a variety of diseases, disorders, and/or conditions, including but not limited to one or more of the following: autoimmune disorders (e.g. diabetes, lupus, multiple sclerosis, psoriasis, rheumatoid arthritis); inflammatory disorders (e.g. arthritis, pelvic inflammatory disease); infectious diseases (e.g. viral infections (e.g., HIV, HCV, RSV), bacterial infections, fungal infections, sepsis); neurological disorders (e.g. Alzheimer's disease, Huntington's disease; autism; Duchenne muscular dystrophy); cardiovascular disorders (e.g. atherosclerosis, hypercholesterolemia, thrombosis, clotting disorders, angiogenic disorders such as macular degeneration); proliferative disorders (e.g. cancer, benign neoplasms); respiratory disorders (e.g. chronic obstructive pulmonary disease); digestive disorders (e.g. inflammatory bowel disease, ulcers); musculoskeletal disorders (e.g. fibromyalgia, arthritis); endocrine, metabolic, and nutritional disorders (e.g. diabetes, osteoporosis); urological disorders (e.g. renal disease); psychological disorders (e.g. depression, schizophrenia); skin disorders (e.g. wounds, eczema); blood and lymphatic disorders (e.g. anemia, hemophilia); etc.

Kits, Vectors, Cells

Some aspects of this disclosure provide kits comprising a nucleic acid construct, comprising (a) a nucleotide sequence encoding a Cas9 protein or a Cas9 fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding a Cas9 protein of a fusion protein as provided herein. Some aspects of this disclosure provide vectors comprising such polynucleotides. In some embodiments, the vector comprises a heterologous promoter driving expression of polynucleotide.

Some aspects of this disclosure provide cells comprising a Cas9 protein, a fusion protein, a nucleic acid molecule encoding the fusion protein, a complex comprise the Cas9 protein and the gRNA, and/or a vector as provided herein.

The description of exemplary embodiments of the reporter systems above is provided for illustration purposes only and not meant to be limiting. Additional reporter systems, e.g., variations of the exemplary systems described in detail above, are also embraced by this disclosure.

EXAMPLES

Example 1: Cas9 Deaminase Fusion Proteins

A number of Cas9:Deaminase fusion proteins were generated and deaminase activity of the generated fusions was characterized. The following deaminases were tested:
Human AID (hAID):

(SEQ ID NO: 49)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPYLSLRIFTARLYFCEDRKAEPEGLRRLHRAGVQIAIMTFKDYFYCWNT

FVENHERTFKAWEGLHENSVRLSRQLRRILLPLYEVDDLRDAFRTLGLLD

Human AID-DC (hAID-DC, Truncated Version of hAID with 7-Fold Increased Activity):

(SEQ ID NO: 50)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPNLSLRIFTARLYFCEDRKAEPEGLRRLHRAGVQIAIMTFKDYFYCWNT

FVENHERTFKAWEGLHENSVRLSRQLRRILL

Rat APOBEC1 (rAPOBEC1):

(SEQ ID NO: 76)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLK

Human APOBEC1 (hAPOBEC1)

(SEQ ID NO: 74)
MTSEKGPSTGDPTLRRRIEPWEFDVFYDPRELRKEACLLYEIKWGMSRKI

WRSSGKNTTNHVEVNFIKKFTSERDFHPSMSCSITWFLSWSPCWECSQAI

REFLSRHPGVTLVIYVARLFWHMDQQNRQGLRDLVNSGVTIQIMRASEYY

HCWRNFVNYPPGDEAHWPQYPPLWMMLYALELHCIILSLPPCLKISRRWQ

NHLTFFRLHLQNCHYQTIPPHILLATGLIHPSVAWR

Petromyzon marinus (Lamprey) CDA1 (pmCDA1):

(SEQ ID NO: 81)
MTDAEYVRIHEKLDIYTFKKQFFNNKKSVSHRCYVLFELKRRGERRACFW

GYAVNKPQSGTERGIHAEIFSIRKVEEYLRDNPGQFTINWYSSWSPCADC

AEKILEWYNQELRGNGHTLKIWACKLYYEKNARNQIGLWNLRDNGVGLNV

MVSEHYQCCRKIFIQSSHNQLNENRWLEKTLKRAEKRRSELSIMIQVKIL

HTTKSPAV

Human APOBEC3G (hAPOBEC3G):

(SEQ ID NO: 60)
MELKYHPEMRFFHWFSKWRKLHRDQEYEVTWYISWSPCTKCTRDMATFLA

EDPKVTLTIFVARLYYFWDPDYQEALRSLCQKRDGPRATMKIMNYDEFQH

CWSKFVYSQRELFEPWNNLPKYYILLHIMLGEILRHSMDPPTFTFNFNNE

PWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCI

FTARIYDDQGRCQEGLRTLAEAGAKISIMTYSEFKHCWDTFVDHQGCPFQ

PWDGLDEHSQDLSGRLRAILQNQEN

Deaminase Activity on ssDNA. A USER (Uracil-Specific Excision Reagent) Enzyme-based assay for deamination was employed to test the activity of various deaminases on single-stranded DNA (ssDNA) substrates. USER Enzyme was obtained from New England Biolabs. An ssDNA substrate was provided with a target cytosine residue at different positions. Deamination of the ssDNA cytosine target residue results in conversion of the target cytosine to a uracil. The USER Enzyme excises the uracil base and cleaves the ssDNA backbone at that position, cutting the ssDNA substrate into two shorter fragments of DNA. In some assays, the ssDNA substrate is labeled on one end with a dye, e.g., with a 5' Cy3 label (the * in the scheme below). Upon deamination, excision, and cleavage of the strand, the substrate can be subjected to electrophoresis, and the substrate and any fragment released from it can be visualized by detecting the label. Where Cy5 is images, only the fragment with the label will be visible via imaging.

In one USER Enzyme assay, ssDNA substrates were used that matched the target sequences of the various deaminases tested. Expression cassettes encoding the deaminases tested were inserted into a CMV backbone plasmid that has been used previously in the lab (Addgene plasmid 52970). The deaminase proteins were expressed using a TNT Quick Coupled Transcription/Translation System (Promega) according to the manufacturers recommendations. After 90 min of incubation, 5 mL of lysate was incubated with 5' Cy3-labeled ssDNA substrate and 1 unit of USER Enzyme (NEB) for 3 hours. The DNA was resolved on a 10% TBE PAGE gel and the DNA was imaged using Cy-dye imaging. A schematic representation of the USER Enzyme assay is shown in FIG. 41.

Figure 1:
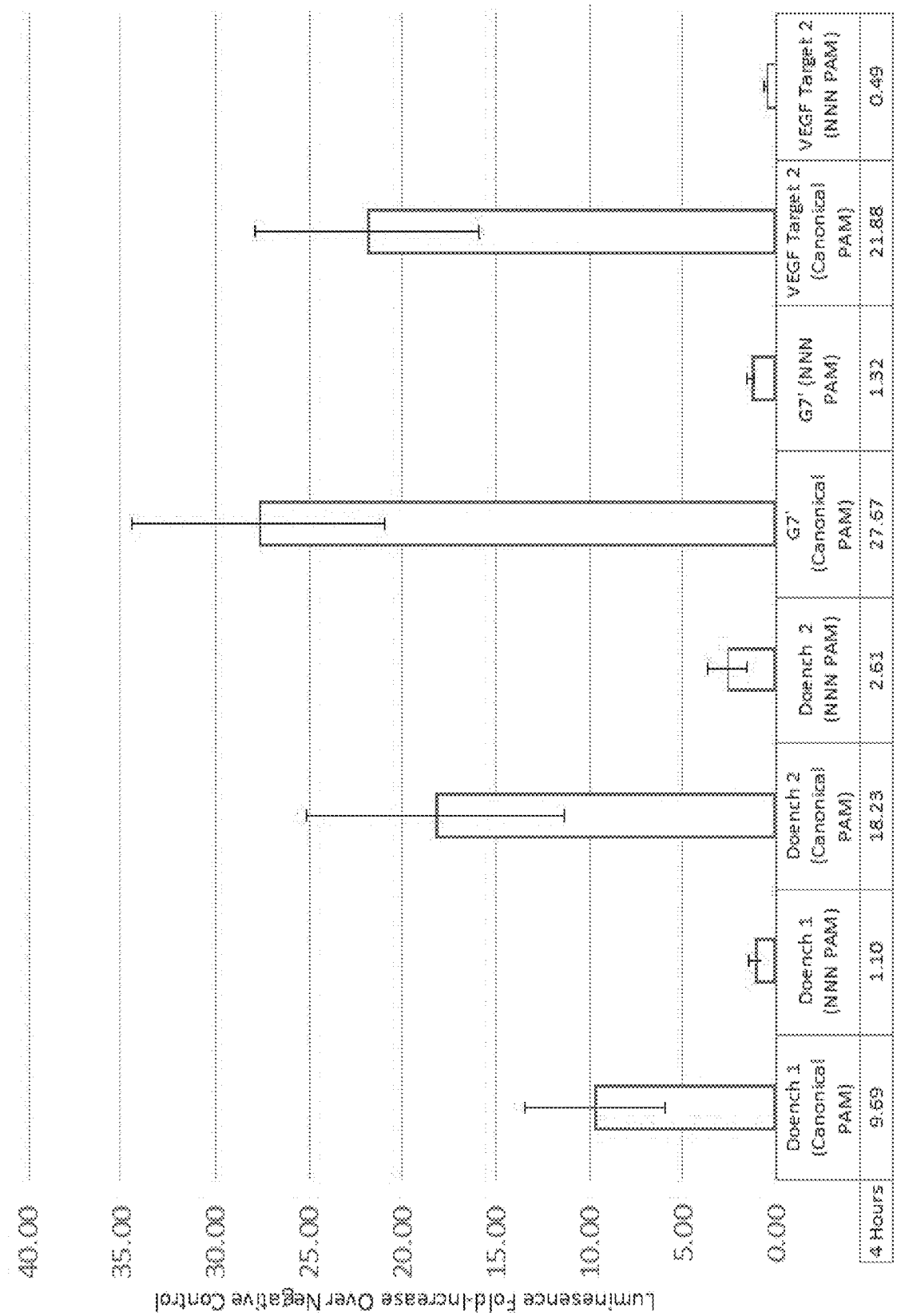
FIG. 1 shows the deaminase activity of deaminases on single stranded DNA substrates. Single stranded DNA substrates using randomized PAM sequences (NNN PAM) were used as negative controls. Canonical PAM sequences used include the (NGG PAM).

FIG. 1 shows the deaminase activity of the tested deaminases on ssDNA substrates, such as Doench 1, Doench 2, G7' and VEGF Target 2. The rAPOBEC1 enzyme exhibited a substantial amount of deamination on the single-stranded DNA substrate with a canonical NGG PAM, but not with a negative control non-canonical NNN PAM. Cas9 fusion proteins with APOBEC family deaminases were generated. The following fusion architectures were constructed and tested on ssDNA:

```
rAPOBEC1-GGS-dCas9 primary sequence
                                                  (SEQ ID NO: 149)
MSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARL

YHHADPRNRQGLRDLISSGVTIQIMTEQESGYCWRNFVNYSPSNEAHWPRYPHLWVR

LYVLELYCIILGLPPCLNILRRKQPQLTFFTIALQSCHYQRLPPHILWATGLK GGS DKKY

SIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSD

VDKLFIQLVQTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWMTRKSEETI

TPWNFEEVVDKGASAQSFIERMTNFDKNLPNEKVLPKHSLLYEYFTVYNELTKVKYV

TEGMRKPAFLSGEQKKAIVDLLFKTNRKVTVKQLKEDYFKKIECFDSVEISGVEDRFN

ASLGTYHDLLKHKDKDFLDNEENEDILEDIVLTLTLFEDREMIEERLKTYAHLFDDK

VMKQLKRRRYTGWGRLSRKLINGIRDKQSGKTILDFLKSDGFANRNFMQLIHDDSLT

FKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQN

GRDMYVDQELDINRLSDYDVDAIVPQSFLKDDSIDNKVLTRSDKNRGKSDNVPSEEVV

KKMKNYWRQLLNAKLITQRKFDNLTKAERGGLSELDKAGFIKRQLVETRQITKHVAQ

ILDSRMNTKYDENDKLIREVKVITLKSKLVSDFRKDFQFYKVREINNYHHAHDAYLNA

VVGTALIKKYPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEVQTGGFSKE

SILPKRNSDKLIARKKDWDPKKYGGFDSPTVAYSVLVVAKVEKGKSKKLKSVKELLGIT

IMERSSFEKNPIDFLEAKGYKEVKKDLIIKLPKYSLFELENGRKRMLASAGELQKGNE

LALPSKYVNFLYLASHYEKLKGSPEDNEQKQLFVEQHKHYLDEHEQISEFSKRVILAD

ANLDKVLSAYNKHRDKPIREQAENIIHLFTLTNLGAPAAFKYFDTTIDRKRYTSTKEVL

DATLIHQSITGLYETRIDLSQLGGD rAPOBEC1-(GGS)3-dCas9 primary sequence
                                                  (SEQ ID NO: 150)
MSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARL

YHHADPRNRQGLRDLISSGVTIQIMTEQESGYCWRNFVNYSPSNEAHWPRYPHLWVR

LYVLELYCIILGLPPCLNILRRKQPQLTFFTIALQSCHYQRLPPHILWATGLK GGSGGSG
```

GSMDKKYSIGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEGD

LNPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKE

IFFDQSKNGYAGYIDGGASQEEFYKFIKPILEKMDGTEELLVKLNREDLLRKQRTFDN

GSIPHQIHLGELHAILRRQEDFYPFLKDNREKIEKILTFRIPYYVGPLARGNSRFAWMT

RKSEETITPWNFEEVVDKGASAQSFIERMTNFDKNLPNEKVLPKHSLLYEYFTVYNEL

TKVKYVTEGMRKPAFLSGEQKKAIVDLLFKTNRKVTVKQLKEDYFKKIECFDSVEISG

VEDRFNASLGTYHDLLKHKDKDFLDNEENEDILEDIVLTLTLFEDREMIEERLKTYA

HLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRH

KPENIVIEMARENQTTQKGQKNSRERMKRIEEGIKELGSQILKEHPVENTQLQNEKLY

LYYLQNGRDMYVDQELDINRLSDYDVDAIVPQSFLKDDSIDNKVLTRSDKNRGKSDNV

PSEEVVKKMKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREINNYHHAH

DAYLNAVVGTALIKKYPKLESEFVYGDYKVYDVRKMIAKSEQEIGKATAKYFFYSNIM

NFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKS

VKELLGITIMERSSFEKNPIDFLEAKGYKEVKKDLIIKLPKYSLFELENGRKRMLASAG

ELQKGNELALPSKYVNFLYLASHYEKLKGSPEDNEQKQLFVEQHKHYLDEHEQISEF

SKRVILADANLDKVLSAYNKHRDKPIREQAENHHLFTLTNLGAPAAFKYFDTTIDRKR

YTSTKEVLDATLIHQSITGLYETRIDLSQLGGD dCas9-GGS-rAPOBEC1

(SEQ ID NO: 151)

DKKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHPI

FGNIVDEVAYHEKYPTIYHLRKKLVDSTDKADLRLIYLALAHMIKFRGHFLIEGDLNP

DNSDVDKLFIQLVQTYNQLFEENPINASGVDAKAILSARLSKSRRLENLIAQLPGEKKN

GLFGNLIALSLGLTPNFKSNFDLAEDAKLQLSKDTYDDDLDNLLAQIGDQYADLFLAA

KNLSDAILLSDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRK

SEETITPWNFEEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIECEDSVEISGVE

DRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVKVMGRHKPE

NIVIEMARENQTTQKGQKNSRERMKRIEEGIKELGSQILKEHPVENTQLQNEKLYLYY

LQNGRDMYVDQELDINRLSDYDVDAIVPQSFLKDDSIDNKVLTRSDKNRGKSDNVPSE

EVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAY

LNAVVGTALIKKYPKLESEFVYGDYKVYDVRKMIAKSEQEIGKATAKYFFYSNIMNFF

KTEITLANGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSKKLKSVKE

LLGITIMERSSFEKNPIDFLEAKGYKEVKKDLIIKLPKYSLFELENGRKRMLASAGELQ

KGNELALPSKYVNFLYLASHYEKLKGSPEDNEQKQLFVEQHKHYLDEHEQISEFSKR

VILADANLDKVLSAYNKHRDKPIREQAENHHLFTLTNLGAPAAFKYFDTTIDRKRYTS

TKEVLDATLIHQSITGLYETRIDLSQLGGD GGS MSSETGPVAVDPTLRRRIEPHEFEVF

FDPRELRKETCLLYEINWGGRHSIWRHTSQNTNKHVEVNFIEKFTTERYFCPNTRCSIT

WFLSWSPCGECSRAITEFLSRYPHVTLFIYIARLYHHADPRNRQGLRDLISSGVTIQIMT

EQESGYCWRNFVNYSPSNEAHWPRYPHLWVRLYVLELYCIILGLPPCLNILRRKQPQL

TFFTIALQSCHYQRLPPHILWATGLK dCas9- GGS₃ -rAPOBEC1

(SEQ ID NO: 152)

DKKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHPI

FGNIVDEVAYHEKYPTIYHLRKKLVDSTDKADLRLIYLALAHMIKFRGHFLIEGDLNP

DNSDVDKLFIQLVQTYNQLFEENPINASGVDAKAILSARLSKSRRLENLIAQLPGEKKN

GLFGNLIALSLGLTPNFKSNFDLAEDAKLQLSKDTYDDDLDNLLAQIGDQYADLFLAA

KNLSDAILLSDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRK

SEETITPWNFEEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIECFDSVEISGVE

DRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVKVMGRHKPE

NIVIEMARENQTTQKGQKNSRERMKRIEEGIKELGSQILKEHPVENTQLQNEKLYLYY

LQNGRDMYVDQELDINRLSDYDVDAIVPQSFLKDDSIDNKVLTRSDKNRGKSDNVPSE

EVVKKMKNYWRQLLNAKLITQRKFDNLTKAERGGLSELDKAGFIKRQLVETRQITKH

-continued

VAQILDSRMNTKYDENDKLIREVKVITLKSKLVSDFRKDFQFYKVREINNYHHAHDAY

LNAVVGTALIKKYPKLESEFVYGDYKVYDVRKMIAKSEQEIGKATAKYFFYSNIMNFF

KTEITLANGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSKKLKSVKE

LLGITIMERSSFEKNPIDFLEAKGYKEVKKDLIIKLPKYSLFELENGRKRMLASAGELQ

KGNELALPSKYVNFLYLASHYEKLKGSPEDNEQKQLFVEQHKHYLDEHEQISEFSKR

VILADANLDKVLSAYNKHRDKPIREQAENHHLFTLTNLGAPAAFKYFDTTIDRKRYTS

TKEVLDATLIHQSITGLYETRIDLSQLGGD GGSGGSGGS MSSETGPVAVDPTLRRRIEP

HEFEVFFDPRELRKETCLLYEINWGGRHSIWRHTSQNTNKHVEVNFIEKFTTERYFCP

NTRCSITWFLSWSPCGECSRAITEFLSRYPHVTLFIYIARLYHHADPRNRQGLRDLISSG

VTIQIMTEQESGYCWRNFVNYSPSNEAHWPRYPHLWVRLYVLELYCIILGLPPCLNIL

RRKQPQLTFFTIALQSCHYQRLPPHILWATGLK rAPOBEC1- XTEN -dCas9 primary sequence (SEQ ID NO: 153)

MSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARL

YHHADPRNRQGLRDLISSGVTIQIMTEQESGYCWRNFVNYSPSNEAHWPRYPHLWVR

LYVLELYCIILGLPPCLNILRRKQPQLTFFTIALQSCHYQRLPPHILWATGLKS GSETPG

TSESATPES DKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEED

KKHERHPIFGNIVDEVAYHEKYPTIYHLRKKLVDSTDKADLRLIYLALAHMIKFRGHF

LIEGDLNPDNSDVDKLFIQLVQTYNQLFEENPINASGVDAKAILSARLSKSRRLENLIA

QLPGEKKNGLFGNLIALSLGLTPNFKSNFDLAEDAKLQLSKDTYDDDLDNLLAQIGD

QYADLFLAAKNLSDAILLSDILRVNTEITKAPLSASMIKRYDEHHQDLTLLKALVRQQL

PEKYKEIFFDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYYVGPLARGNS

RFAWMTRKSEETITPWNFEEVVDKGASAQSFIERMTNFDKNLPNEKVLPKHSLLYEY

FTVYNELTKVKYVTEGMRKPAFLSGEQKKAIVDLLFKTNRKVTVKQLKEDYFKKIECF

DSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANR

NFMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNR

GKSDNVPSEEVVKKMKNYWRQLLNAKLITQRKFDNLTKAERGGLSELDKAGFIKRQL

VETRQITKHVAQILDSRMNTKYDENDKLIREVKVITLKSKLVSDFRKDFQFYKVREIN

NYHHAHDAYLNAVVGTALIKKYPKLESEFVYGDYKVYDVRKMIAKSEQEIGKATAKYF

FYSNIMNFFKTEITLANGEIRKRPLIETNGETGEIVWDKGRDFATVRKVLSMPQVNIV

-continued

KKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLHKLPKYSLFELENGRKR

MLASAGELQKGNELALPSKYVNFLYLASHYEKLKGSPEDNEQKQLFVEQHKHYLDEI

IEQISEFSKRVILADANLDKVLSAYNKHRDKPIREQAENIIHLFTLTNLGAPAAFKYFD

TTIDRKRYTSTKEVLDATLIHQSITGLYETRIDLSQLGGD

Figure 2:
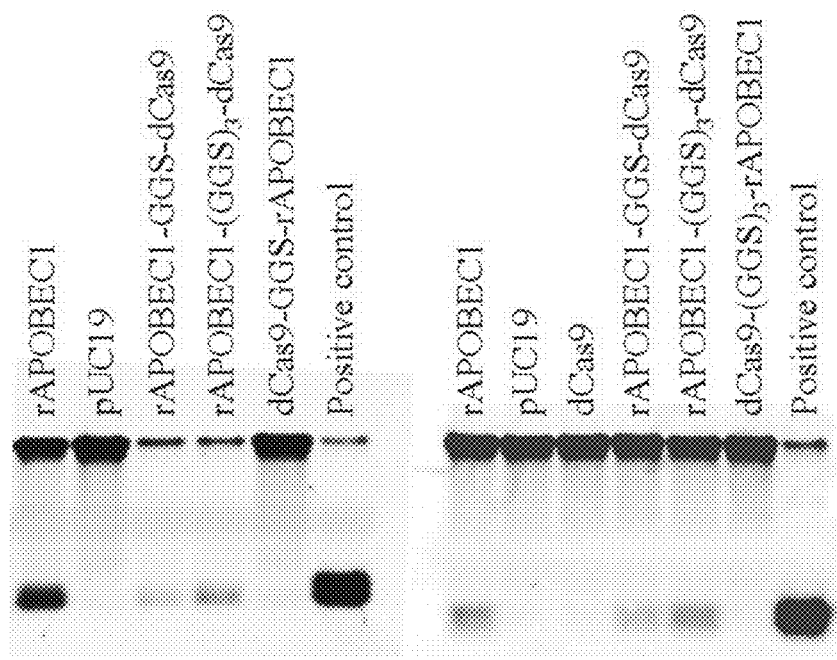
FIG. 2 shows the activity of Cas9:deaminase fusion proteins on single stranded DNA substrates.

FIG. 2 shows that the N-terminal deaminase fusions showed significant activity on the single stranded DNA substrates. For this reason, only the N-terminal architecture was chosen for further experiments.

FIG. 3 illustrates double stranded DNA substrate binding by deaminase-dCas9:sgRNA complexes. A number of double stranded deaminase substrate sequences were generated. The sequences are provided below. The structures according to FIG. 3 are identified in these sequences (36 bp: underlined, sgRNA target sequence: bold; PAM: boxed; 21 bp: italicized). All substrates were labeled with a 5'-Cy3 label:

```
                                                  (SEQ ID NO: 85)
2: GTAGGTAGTTAGGATGAATGGAAGGTTGGTATAGTCCCGCGGATTTATTTATTTA
   A TGG ATGACCTCTGGATCCATGGAC-3'

(SEQ ID NO: 86)
3: GTAGGTAGTTAGGATGAATGGAAGGTTGGTATAGCTTCCGCGGATTTATTTATTT
   A TGG ATGACCTCTGGATCCATGGAC-3'

(SEQ ID NO: 87)
4: GTAGGTAGTTAGGATGAATGGAAGGTTGGTATAGCCTTCCGCGGATTTATTTATT
   A TGG ATGACCTCTGGATCCATGGAC-3'

(SEQ ID NO: 88)
5: GTAGGTAGTTAGGATGAATGGAAGGTTGGTATAGCCATTCCGCGGATTTATTTAT
   T TGG ATGACCTCTGGATCCATGGAC-3'

(SEQ ID NO: 89)
6: GTAGGTAGTTAGGATGAATGGAAGGTTGGTATAGCCTATTCCGCGGATTTATTTA
   T TGG ATGACCTCTGGATCCATGGAC-3'

(SEQ ID NO: 90)
7: GTAGGTAGTTAGGATGAATGGAAGGTTGGTATAGCCTTATTCCGCGGATTTATTT
   A TGG ATGACCTCTGGATCCATGGAC-3'

(SEQ ID NO: 91)
8: GTAGGTAGTTAGGATGAATGGAAGGTTGGTATAGCCATTATTCCGCGGATTTATT
   T TGG ATGACCTCTGGATCCATGGAC-3'

(SEQ ID NO: 92)
9: GTAGGTAGTTAGGATGAATGGAAGGTTGGTATAGCCTATTATTCCGCGGATTTAT
   T TGG ATGACCTCTGGATCCATGGAC-3'

(SEQ ID NO: 93)
10: GTAGGTAGTTAGGATGAATGGAAGGTTGGTATAGCCATTATATTCCGCGGATTT
    AT TGG ATGACCTCTGGATCCATGGAC-3'

(SEQ ID NO: 94)
11: GTAGGTAGTTAGGATGAATGGAAGGTTGGTATAGCCTATTATATTCCGCGGATT
    TA TGG ATGACCTCTGGATCCATGGAC-3'
```

-continued (SEQ ID NO: 95)
12: <u>GTAGGTAGTTAGGATGAATGGAAGGTTGGTATAGCC</u>TTATTATATTCCGCGGAT

TTTGG*ATGACCTCTGGATCCATGGAC*-3'

(SEQ ID NO: 96)
13: <u>GTAGGTAGTTAGGATGAATGGAAGGTTGGTATAGCC</u>ATTATTATATTCCGCGGA

TTTGG*ATGACCTCTGGATCCATGGAC*-3'

(SEQ ID NO: 97)
14: <u>GTAGGTAGTTAGGATGAATGGAAGGTTGGTATAGCC</u>TATTATTATATTCCGCGG

ATTGG*ATGACCTCTGGATCCATGGAC*-3'

(SEQ ID NO: 98)
15: <u>GTAGGTAGTTAGGATGAATGGAAGGTTGGTATAGCC</u>ATTATTATTATTACCGCG

GATGG*ATGACCTCTGGATCCATGGAC*-3'

(SEQ ID NO: 99)
18: <u>GTAGGTAGTTAGGATGAATGGAAGGTTGGTATAGCC</u>ATTATTATTATTATTACCG

CTGG*ATGACCTCTGGATCCATGGAC*-3'

"-":

(SEQ ID NO: 100)
<u>GTAGGTAGTTAGGATGAATGGAAGGTTGGTATAGTA</u>ATATTAATTTATTTATTTAAT

GG*ATGACCTCTGGATCCATGGAC*-3'

(SEQ ID NO: 101)
8U: <u>GTAGGTAGTTAGGATGAATGGAAGGTTGGTGTAG</u>ATTATTATCUGCGGATTTAT

TGG*ATGACCTCTGGATCCATGGACAT*-3'

*In all substrates except for "8U", the top strand in FIG. 3
is the complement of the sequence specified here. In the case
of "8U", there is a "G" opposite the U.

Figure 4:
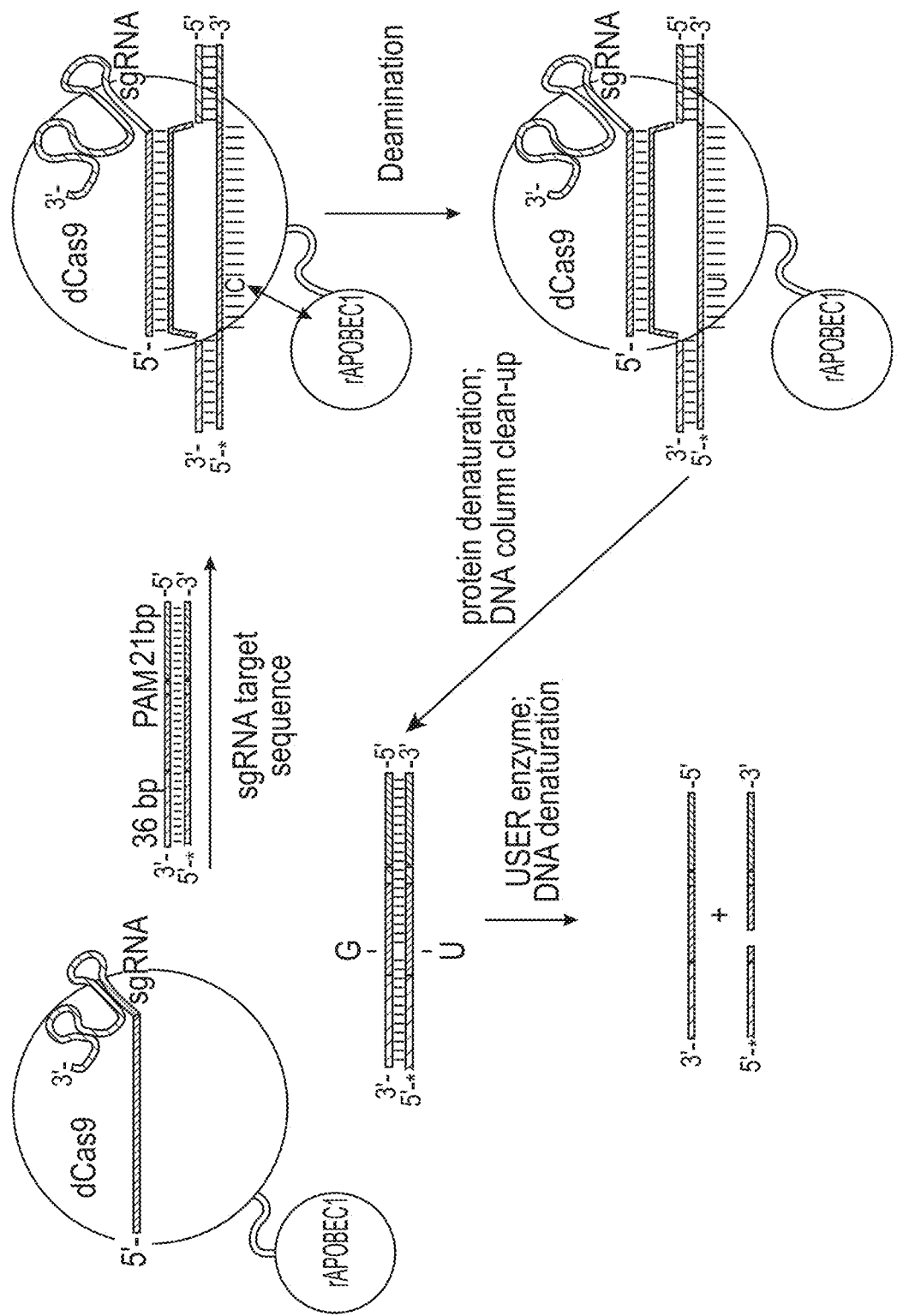
FIG. 4 illustrates a double stranded DNA deamination assay.

FIG. 4 shows the results of a double stranded DNA Deamination Assay. The fusions were expressed and purified with an N-terminal His6 tag via both Ni-NTA and sepharose chromatography. In order to assess deamination on dsDNA substrates, the various dsDNA substrates shown on the previous slide were incubated at a 1:8 dsDNA:fusion protein ratio and incubated at 37° C. for 2 hours. Once the dCas9 portion of the fusion binds to the DNA it blocks access of the USER enzyme to the DNA. Therefore, the fusion proteins were denatured following the incubation and the dsDNA was purified on a spin column, followed by incubation for 45 min with the USER Enzyme and resolution of the resulting DNA substrate and substrate fragments on a 10% TBE-urea gel.

Figure 5:
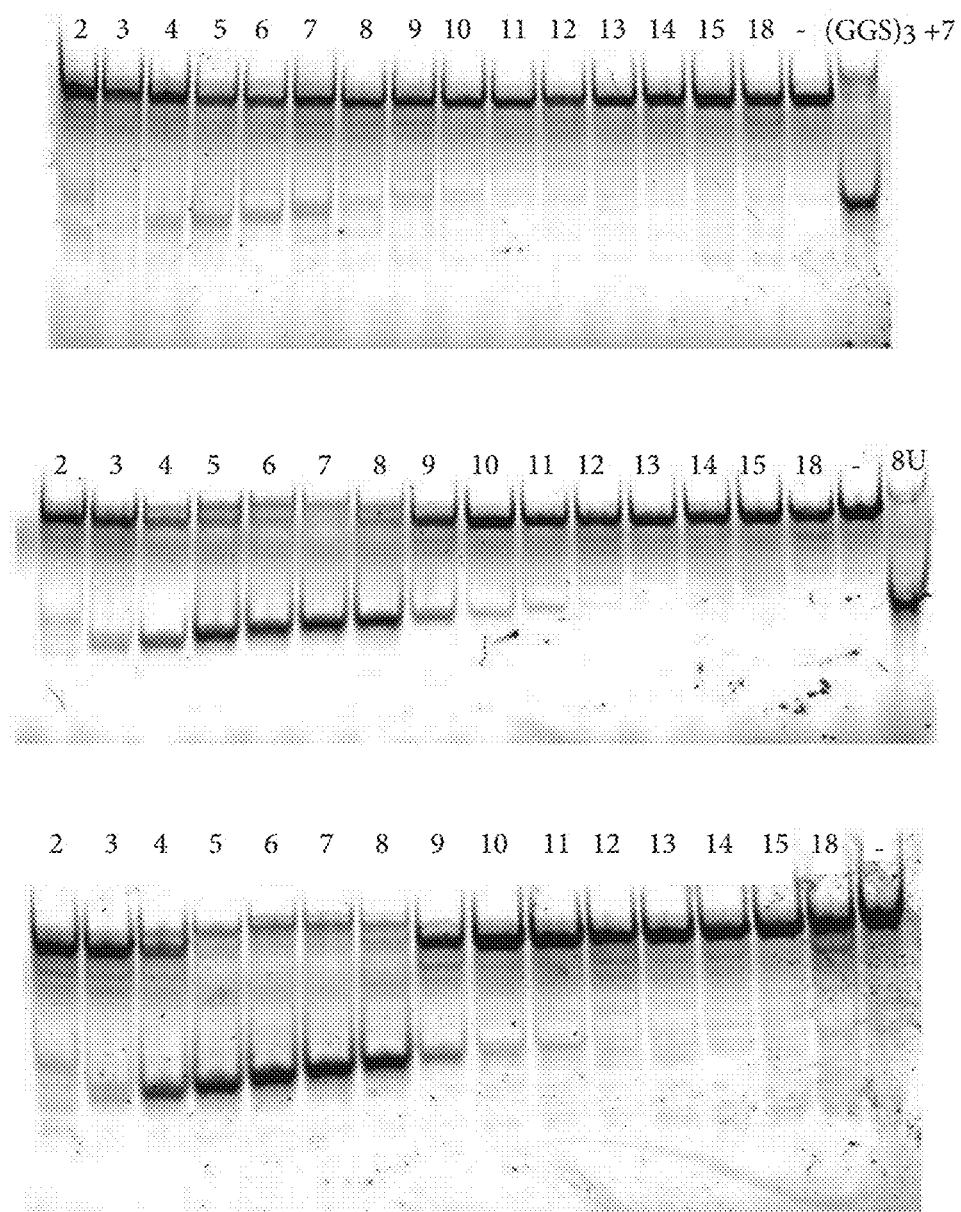
FIG. 5 demonstrates that Cas9 fusions can target positions 3-11 of double-stranded DNA target sequences (numbered according to the schematic in FIG. 5). Upper Gel: 1 µM rAPOBEC1-GGS-dCas9, 125 nM dsDNA, 1 equivalent sgRNA. Mid Gel: 1 µM rAPOBEC1-(GGS)$_3$(SEQ ID NO: 610)-dCas9, 125 nM dsDNA, 1 equivalent sgRNA. Lower Gel: 1.85 µM rAPOBEC1-XTEN-dCas9, 125 nM dsDNA, 1 equivalent sgRNA.

FIG. 5 demonstrates that Cas9 fusions can target positions 3-11 of double-stranded DNA target sequences (numbered according to the schematic in FIG. 3). Upper Gel: 1 μM rAPOBEC1-GGS-dCas9, 125 nM dsDNA, 1 eq sgRNA. Mid Gel: 1 μM rAPOBEC1-(GGS)$_3$-dCas9, 125 nM dsDNA, 1 eq sgRNA. Lower Gel: 1.85 μM rAPOBEC1-XTEN-dCas9, 125 nM dsDNA, 1 eq sgRNA. Based on the data from these gels, positions 3-11 (according to the numbering in FIG. 3) are sufficiently exposed to the activity of the deaminase to be targeted by the fusion proteins tested. Access of the deaminase to other positions is most likely blocked by the dCas9 protein.

The data further indicates that a linker of only 3 amino acids (GGS) is not optimal for allowing the deaminase to access the single stranded portion of the DNA. The 9 amino acid linker [(GGS)$_3$] (SEQ ID NO: 610) and the more structured 16 amino acid linker (XTEN) allow for more efficient deamination.

Figure 6:
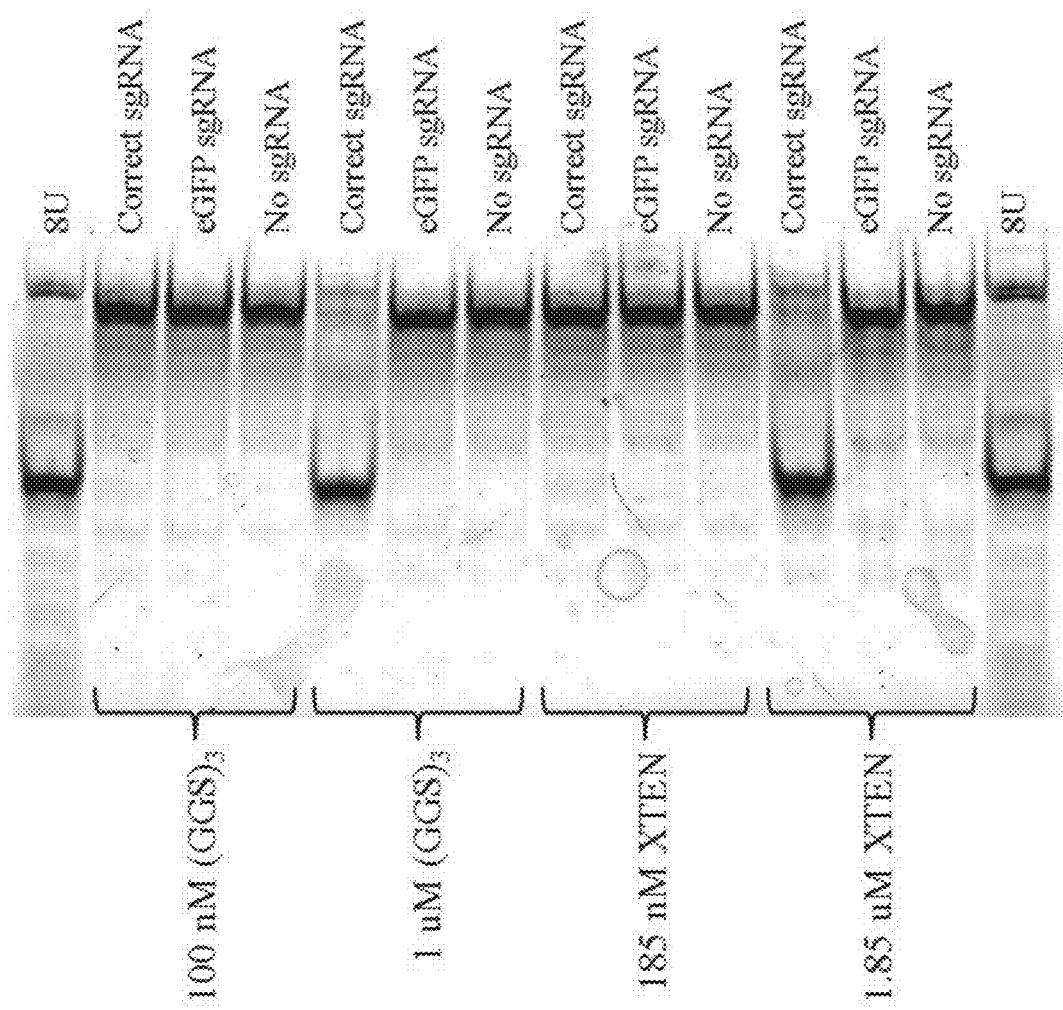
FIG. 6 demonstrates that the correct guide RNA, e.g., the correct sgRNA, is required for deaminase activity.

FIG. 6 demonstrates that the correct guide RNA, e.g., the correct sgRNA, is required for deaminase activity. The gel shows that fusing the deaminase to dCas9, the deaminase enzyme becomes sequence specific (e.g., using the fusion with an eGFP sgRNA results in no deamination), and also confers the capacity to the deaminase to deaminate dsDNA. The native substrate of the deaminase enzyme is ssDNA, and no deamination occurred when no sgRNA was added. This is consistent with reported knowledge that APOBEC deaminase by itself does not deaminate dsDNA. The data indicates that Cas9 opens the double-stranded DNA helix within a short window, exposing single-stranded DNA that is then accessible to the APOBEC deaminase for cytidine deamination. The sgRNA sequences used are provided below. sequences (36 bp: underlined, sgRNA target sequence: bold; PAM: boxed; 21 bp: italicized) DNA sequence 8:

5'-Cy3-

(SEQ ID NO: 102)
<u>GTAGGTAGTTAGGATGAATGGAAGGTTGGTATAGCC</u>ATTATTCCGCGGAT

TTATTTTGG*ATGACCTCTGGATCCATGGAC*-3'

Correct sgRNA Sequence (Partial 3' Sequence):

(SEQ ID NO: 103)
5'-AUUAUUCCGCGGAUUUAUUUGUUUUAGAGCUAG . . . -3' eGFP sgRNA Sequence (Partial 3'-Sequence:

(SEQ ID NO: 104)
5'-CGUAGGCCAGGGUGGUCACGGUUUUAGAGCUAG . . . -3'

Example 2: Deamination of DNA Target Sequence

Figure 7:
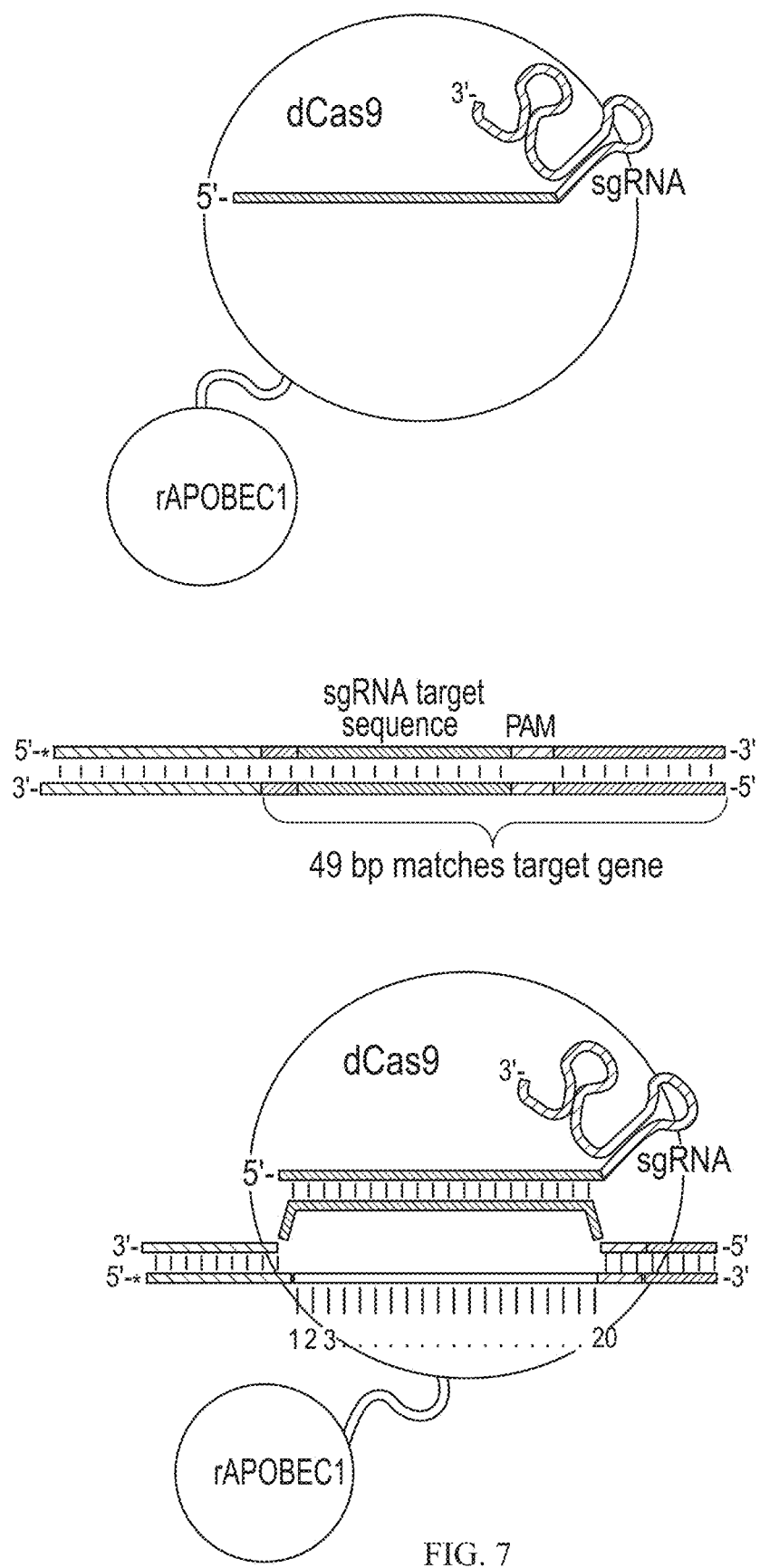
FIG. 7 illustrates the mechanism of target DNA binding of in vivo target sequences by deaminase-dCas9:sgRNA complexes.

Exemplary deamination targets. The dCas9:deaminase fusion proteins described herein can be delivered to a cell in vitro or ex vivo or to a subject in vivo and can be used to effect C to T or G to A transitions when the target nucleotide is in positions 3-11 with respect to a PAM. Exemplary deamination targets include, without limitation, the following: CCR5 truncations: any of the codons encoding Q93, Q102, Q186, R225, W86, or Q261 of CCR5 can be deaminated to generate a STOP codon, which results in a non-functional truncation of CCR5 with applications in HIV treatment. APOE4 mutations: mutant codons encoding C11R and C57R mutant APOE4 proteins can be deaminated to revert to the wild-type amino acid with applications in Alzheimer's treatment. eGFP truncations: any of the codons encoding Q158, Q184, Q185 can be deaminated to generate a STOP codon, or the codon encoding M1 can be deaminated to encode I, all of which result in loss of eGFP fluorescence, with applications in reporter systems. eGFP restoration: a mutant codon encoding T65A or Y66C mutant GFP, which does not exhibit substantial fluorescence, can be deaminated to restore the wild-type amino acid and confer fluorescence. PIK3CA mutation: a mutant codon encoding K111E mutant PIK3CA can be deaminated to restore the wild-type amino acid residue with applications in cancer. CTNNB1 mutation: a mutant codon encoding T41A mutant CTNNB1 can be deaminated to restore the wild-type amino acid residue with applications in cancer. HRAS mutation: a mutant codon encoding Q61R mutant HRAS can be deaminated to restore the wild-type amino acid residue with applications in cancer. P53 mutations: any of the mutant codons encoding Y163C, Y236C, or N239D mutant p53 can be deaminated to encode the wild type amino acid sequence with applications in cancer. The feasibility of deaminating these target sequences in double-stranded DNA is demonstrated in FIGS. 7 and 8. FIG. 7 illustrates the mechanism of target DNA binding of in vivo target sequences by deaminase-dCas9:sgRNA complexes.

Figure 8:
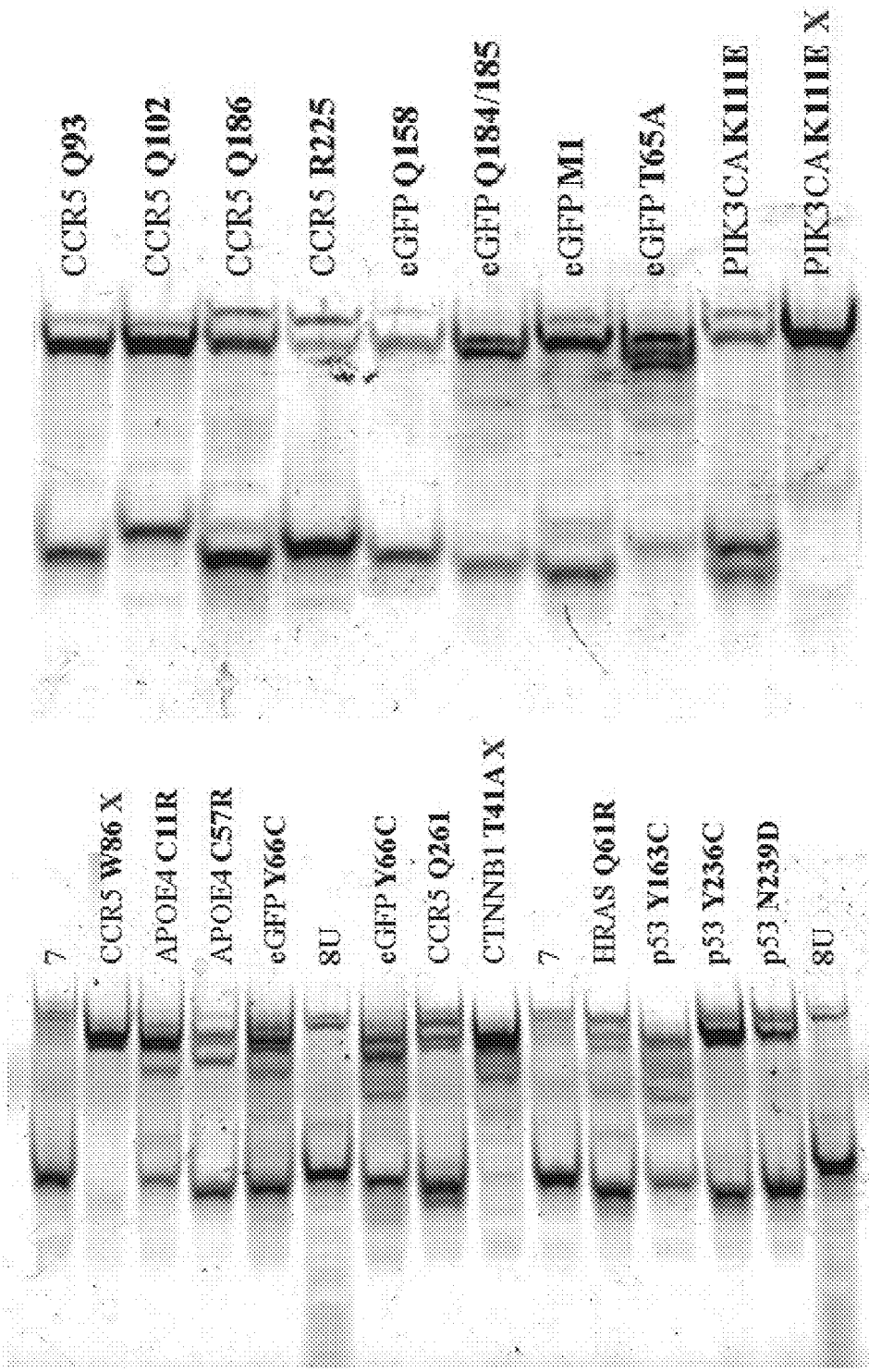
FIG. 8 shows successful deamination of exemplary disease-associated target sequences.

FIG. 8 shows successful deamination of exemplary disease-associated target sequences. Upper Gel: CCR5 Q93: coding strand target in pos. 10 (potential off-targets at positions 2, 5, 6, 8, 9); CCR5 Q102: coding strand target in pos. 9 (potential off-targets at positions 1, 12, 14); CCR5 Q186: coding strand target in pos. 9 (potential off-targets at positions 1, 5, 15); CCR5 R225: coding strand target in pos. 6 (no potential off-targets); eGFP Q158: coding strand target in pos. 5 (potential off-targets at positions 1, 13, 16); eGFP Q184/185: coding strand target in pos. 4 and 7 (potential off-targets at positions 3, 12, 14, 15, 16, 17, 18); eGFP M1: template strand target in pos. 12 (potential off-targets at positions 2, 3, 7, 9, 11) (targets positions 7 and 9 to small degree); eGFP T65A: template strand target in pos. 7 (potential off-targets at positions 1, 8, 17); PIK3CA K111E: template strand target in pos. 2 (potential off-targets at positions 5, 8, 10, 16, 17); PIK3CA K111E: template strand target in pos. 13 (potential off-targets at positions 11, 16, 19) X. Lower Gel: CCR5 W86: template strand target in pos. 2 and 3 (potential off-targets at positions 1, 13) X; APOE4 C11R: coding strand target in pos. 11 (potential off-targets at positions 7, 13, 16, 17); APOE4 C57R: coding strand target in pos. 5) (potential off-targets at positions 7, 8, 12); eGFP Y66C: template strand target in pos. 11 (potential off-targets at positions 1, 4, 6, 8, 9, 16); eGFP Y66C: template strand target in pos. 3 (potential off-targets at positions 1, 8, 17); CCR5 Q261: coding strand target in pos. 10 (potential off-targets at positions 3, 5, 6, 9, 18); CTNNB1 T41A: template strand target in pos. 7 (potential off-targets at positions 1, 13, 15, 16) X; HRAS Q61R: template strand target in pos. 6 (potential off-targets at positions 1, 2, 4, 5, 9, 10, 13); p53 Y163C: template strand target in pos. 6 (potential off-targets at positions 2, 13, 14); p53 Y236C: template strand target in pos. 8 (potential off-targets at positions 2, 4); p53 N239D: template strand target in pos. 4 (potential off-targets at positions 6, 8). Exemplary DNA sequences of disease targets are provided below (PAMs (5'-NGG-3') and target positions are boxed):

```
CCR5 Q93: 5'-Cy3-
                                                         (SEQ ID NO: 105)
GTAGGTAGTTAGGATGAATGGAAGGTTGGTAACTATGCTGCCGCC

[C]AGTGGGACTT[TGG]AAATACAATGTGTCAACTCTT-3'

(SEQ ID NO: 106)
CCR5 Q102: 5'-Cy3-
GTAGGTAGTTAGGATGAATGGAAGGTTGGTAAAATACAATGTGT

[C]AACTCTTGACA[GGG]CTCTATTTTATAGGCTTCTTC-3'

CCR5 Q186: 5'-Cy3-
                                                         (SEQ ID NO: 107)
GTAGGTAGTTAGGATGAATGGAAGGTTGGTATTTTCCATACAGT

[C]AGTATCAATTC[TGG]AAGAATTTCCAGACATTAAAG-3'

CCR5 R225: 5'-Cy3-
                                                         (SEQ ID NO: 108)
GTAGGTAGTTAGGATGAATGGAAGGTTGGTAGCTTCGGTGT[C]GA

AATGAAGAAGAAG[AGG]CACAGGGCTGTGAGGCTTATC-3'
```

-continued

CCR5 W86: 5'-Cy3-
(SEQ ID NO: 109)
<u>GTAGGTAGTTAGGATGAATGGAAGGTTGGTAGTGAGC</u>CCAGAAGG

GGACAGTAAGAAGGAAAAACAGGTCAGAGATGGCC-3'

CCR5 Q261: 5'-Cy3-
(SEQ ID NO: 110)
<u>GTAGGTAGTTAGGATGAATGGAAGGTTGGTATCCTG</u>AACACCTT

CCAGGAATTCTTTGG*CCTGAATAATTGCAGTAGCTC*-3'

APOE4 C11R: 5'-Cy3-
(SEQ ID NO: 111)
<u>GTAGGTAGTTAGGATGAATGGAAGGTTGGTAGACAT</u>GGAGGAC

GTCGCGGCCGCCTGG*TGCAGTACCGCGGCGAGGTGC*-3'

APOE4 C57R: 5'-Cy3-
(SEQ ID NO: 112)
<u>GTAGGTAGTTAGGATGAATGGAAGGTTGGTACTGCA</u>GAAGCGC

CTGGCAGTGTACCAGG*CCGGGGCCCGCGAGGGCGCCG*-3' eGFP Q158: 5'-Cy3-
(SEQ ID NO: 113)
<u>GTAGGTAGTTAGGATGAATGGAAGGTTGGTAGCCGA</u>CAAGCAGA

AGAACGGCATCAAGG*TGAACTTCAAGATCCGCCACA*-3'

(SEQ ID NO: 114)
eGFP Q184/185: 5'-Cy3-<u>GTAGGTAGTTAGGATGAATGGAAGGTTGGTAACCAC</u>TACC

AGCAGAACACCCCCATCGG*CGACGGCCCCGTGCTGCTGCC*-3' eGFP M1: 5'-Cy3-
(SEQ ID NO: 115)
<u>GTAGGTAGTTAGGATGAATGGAAGGTTGGTACCTCG</u>CCCTTGCTCA

CCATCTCGAGTCGG*CCGCCAGTGTGATGGATATCT*-3' eGFP T65A: 5'-Cy3-
(SEQ ID NO: 116)
<u>GTAGGTAGTTAGGATGAATGGAAGGTTGGTACACGC</u>GTAGGCCA

GGGTGGTCACGAGG*GTGGGCCAGGGCACGGGCAGC*-3' eGFP Y66C: 5'-Cy3-
(SEQ ID NO: 117)
<u>GTAGGTAGTTAGGATGAATGGAAGGTTGGTAAAGCA</u>CTGCACTC

CGCAGGTCAGGGTGG*TCACGAGGGTTGGCCAGGGCA*-3' eGFP Y66C: 5'-Cy3-
(SEQ ID NO: 118)
<u>GTAGGTAGTTAGGATGAATGGAAGGTTGGTACACTCC</u>GCAGGTC

AGGGTGGTCACGAGG*GTTGGCCAGGGCACGGGCAGG*-3'

(SEQ ID NO: 119)
PIK3CA K111E: 5'-Cy3-<u>GTAGGTAGTTAGGATGAATGGAAGGTTGGTAGGATCT</u>CTTTC

TTCACGGTTGCCTACTGG*TTCAATTACTTTTAAAAATGG*-3'

(SEQ ID NO: 120)
PIK3CA K111E: 5'-Cy3-<u>GTAGGTAGTTAGGATGAATGGAAGGTTGGTATTCTC</u>GATTG

AGGATCTCTTCTTCACGG*TTGCCTACTGGTTCAATTACT*-3'

```
CTNNB1 T41A: 5'-Cy3-
                                                                 (SEQ ID NO: 121)
GTAGGTAGTTAGGATGAATGGAAGGTTGGTAAGGAGCTGTGG

CAGTGGCACCAGAATGGATTCCAGAGTCCAGGTAAGAC-3'

HRAS Q61R: 5'-Cy3-
                                                                 (SEQ ID NO: 122)
GTAGGTAGTTAGGATGAATGGAAGGTTGGTAGTACTCCTCCGGG

CCGGCGGTATCCAGGATGTCCAACAGGCACGTCTCC-3' p53 Y163C: 5'-Cy3-
                                                                 (SEQ ID NO: 123)
GTAGGTAGTTAGGATGAATGGAAGGTTGGTATGACTGCTTGCAG

ATGGCCATGGCGCGGACGCGGGTGCCGGGCGGGGT-3' p53 Y236C: 5'-Cy3-
                                                                 (SEQ ID NO: 124)
GTAGGTAGTTAGGATGAATGGAAGGTTGGTACTGTTACACATGC

AGTTGTAGTGGATGGTGGTACAGTCAGAGCCAACCT-3' p53 N239D: 5'-Cy3-
                                                                 (SEQ ID NO: 125)
GTAGGTAGTTAGGATGAATGGAAGGTTGGTAGGAACTGTCACAC

ATGTAGTTGTAGTGGATGGTGGTACAGTCAGAGCCA-3'
```

Example 3: Uracil Glycosylase Inhibitor Fusion Improves Deamination Efficiency Direct programmable nucleobase editing efficiencies in mammalian cells by dCas9:deaminase fusion proteins can be improved significantly by fusing a uracil glycosylase inhibitor (UGI) to the dCas9:deaminase fusion protein.

FIG. 9 shows in vitro C→T editing efficiencies in human HEK293 cells using rAPOBEC1-XTEN-dCas9:

```
rAPOBEC1-XTEN-dCas9-NLS primary sequence
                                                                 (SEQ ID NO: 126)
MSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARLY

HHADPRNRQGLRDLISSGVTIQIMTEQESGYCWRNFVNYSPSNEAHWPRYPHLWVRL

YVLELYCIILGLPPCLNILRRKQPQLTFFTIALQSCHYQRLPPHILWATGLKSGSETPGTS

ESATPESDKKYSIGLAIGTNSVGWAVITDEYKVPSKKFKVLGNTDRHSIKKNLIGALLF

DSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIE

GDLNPDNSDVDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLLKALVRQQLPEK

YKEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAWM

TRKSEETITPWNFEEVVDKGASAQSFIERMTNFDKNLPNEKVLPKHSLLYEYFTVYNE

LTKVKYVTEGMRKPAFLSGEQKKAIVDLLFKTNRKVTVKQLKEDYFKKIECFDSVEIS
```

-continued

GVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRH

KPENIVIEMARENQTTQKGQKNSRERMKRIEEGIKELGSQILKEHPVENTQLQNEKLYL

YYLQNGRDMYVDQELDINRLSDYDVDAIVPQSFLKDDSIDNKVLTRSDKNRGKSDNV

PSEEVVKKMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVREINNYHHAH

DAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDR

KRYTSTKEVLDATLIHQSITGLYETRIDLSQLGGD SGGS PKKKRKV

Protospacer Sequences were as Follows:

EMX1:  (SEQ ID NO: 127)
5'-GAGTC$_5$C$_6$GAGC$_{10}$AGAAGAAGAA GGG -3'

FANCF:  (SEQ ID NO: 128)
5'-GGAATC$_6$C$_7$C$_8$TTC$_{11}$TGCAGCACC TGG -3'

HEK293 site 2:  (SEQ ID NO: 129)
5'-GAAC$_4$AC$_6$AAAGC$_{11}$ATAGACTGC GGG -3'

HEK293 site 3:  (SEQ ID NO: 130)
5'-GGC$_3$C$_4$C$_5$AGAC$_9$TGAGCACGTGA TGG -3'

HEK293 site 4:  (SEQ ID NO: 735)
5'-GGC$_3$AC$_5$TGC$_8$GGC$_{11}$TGGAGGTGC GGG -3'

RNF2:  (SEQ ID NO: 132)
5'-GTC$_3$ATC$_6$TTAGTCATTACCTG AGG -3'

*PAMs are boxed, C residues within target window (positions 3-11) are numbered and bolded.

FIG. 10 demonstrates that C→T editing efficiencies on the same protospacer sequences in HEK293T cells are greatly enhanced when a UGI domain is fused to the rAPOBEC1: dCas9 fusion protein.

rAPOBEC1-XTEN-dCas9-UGI-NLS primary sequence (SEQ ID NO: 133)
MSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARLY

HHADPRNRQGLRDLISSGVTIQIMTEQESGYCWRNFVNYSPSNEAHWPRYPHLWVRL

YVLELYCIILGLPPCLNILRRKQPQLTFFTIALQSCHYQRLPPHILWATGLKSGSETPGTS

ESATPESDKKYSIGLAIGTNSVGWAVITDEYKVPSKKFKVLGNTDRHSIKKNLIGALLF

DSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIE

GDLNPDNSDVDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLLKALVRQQLPEK

YKEIFFDQSKNGYAGYIDGGASQEEFYKFIKPILEKMDGTEELLVKLNREDLLRKQRTF

-continued

DNGSIPHQIHLGELHAILRRQEDFYPFLKDNREKIEKILTFRIPYYVGPLARGNSRFAWM

TRKSEETITPWNFEEVVDKGASAQSFIERMTNFDKNLPNEKVLPKHSLLYEYFTVYNE

LTKVKYVTEGMRKPAFLSGEQKKAIVDLLFKTNRKVTVKQLKEDYFKKIECFDSVEIS

GVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRH

KPENIVIEMARENQTTQKGQKNSRERMKRIEEGIKELGSQILKEHPVENTQLQNEKLYL

YYLQNGRDMYVDQELDINRLSDYDVDAIVPQSFLKDDSIDNKVLTRSDKNRGKSDNV

PSEEVVKKMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVREINNYHHAH

DAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDR

KRYTSTKEVLDATLIHQSITGLYETRIDLSQLGGDSGGSTNLSDIIEKETGKQLVIQESI

LMLPEEVEEVIGNKPESDILVHTAYDESTDENVMLLTSDAPEYKPWALVICIDSNGE

NKIKMLSGGS*PKKKRKV*

The percentages in FIGS. 9 and 10 are shown from sequencing both strands of the target sequence. Because only one of the strands is a substrate for deamination, the maximum possible deamination value in this assay is 50%. Accordingly, the deamination efficiency is double the percentages shown in the tables. E.g., a value of 50% relates to deamination of 100% of double-stranded target sequences. When a uracil glycosylase inhibitor (UGI) was fused to the dCas9:deaminase fusion protein (e.g., rAPOBEC1-XTEN-dCas9-[UGI]-NLS), a significant increase in editing efficiency in cells was observed. This result indicates that in mammalian cells, the DNA repair machinery that cuts out the uracil base in a U:G base pair is a rate-limiting process in DNA editing. Tethering UGI to the dVas9:deaminase fusion proteins greatly increases editing yields.

Without UGI, typical editing efficiencies in human cells were in the ~2-14% yield range (FIG. 9 and FIG. 10, "XTEN" entries). With UGI (FIG. 10, "UGI" entries) the editing was observed in the ~6-40% range. Using a UGI fusion is thus more efficient than the current alternative method of correcting point mutations via HDR, which also creates an excess of indels in addition to correcting the point mutation. No indels resulting from treatment with the cas9:deaminase:UGI fusions were observed.

Example 4: Direct, Programmable Conversion of a Target Nucleotide in Genomic DNA without Double-Stranded DNA Cleavage Current genome-editing technologies introduce double-stranded DNA breaks at a target locus of interest as the first step to gene correction.[39,40] Although most genetic diseases arise from mutation of a single nucleobase to a different nucleobase, current approaches to revert such changes are very inefficient and typically induce an abundance of random insertions and deletions (indels) at the target locus as a consequence of the cellular response to double-stranded DNA breaks.[39,40] Reported herein is the development of nucleobase editing, a new strategy for genome editing that enables the direct conversion of one target nucleobase into another in a programmable manner, without requiring double-stranded DNA backbone cleavage. Fusions of CRISPR/Cas9 were engineered and the cytidine deaminase enzyme APOBEC1 that retain the ability to be programmed with a guide RNA, do not induce double-stranded DNA breaks, and mediate the direct conversion of cytidine to uracil, thereby effecting a C→T (or G→A) substitution following DNA replication, DNA repair, or transcription if the template strand is targeted. The resulting "nucleobase editors" convert cytidines within a window of approximately five nucleotides, and can efficiently correct a variety of point mutations relevant to human disease in vitro. In four transformed human and murine cell lines, second- and third-generation nucleobase editors that fuse uracil glycosylase inhibitor (UGI), and that use a Cas9 nickase targeting the non-edited strand, respectively, can overcome the cellular DNA repair response to nucleobase editing, resulting in permanent correction of up to 37% or (~15-75%) of total cellular DNA in human cells with minimal (typically ≤1%) indel formation. In contrast, canonical Cas9-mediated HDR on the same targets yielded an average of 0.7% correction with 4% indel formation. Nucleobase editors were used to revert two oncogenic p53 mutations into wild-type alleles in human breast cancer and lymphoma cells, and to convert an Alzheimer's Disease associated Arg codon in ApoE4 into a non-disease-associated Cys codon in mouse astrocytes. Base editing expands the scope and efficiency of genome editing of point mutations.

The clustered regularly interspaced short palindromic repeat (CRISPR) system is a prokaryotic adaptive immune system that has been adapted to mediate genome engineering in a variety of organisms and cell lines.[41] CRISPR/Cas9 protein-RNA complexes localize to a target DNA sequence through base pairing with a guide RNA, and natively create a DNA double-stranded break (DSB) at the locus specified by the guide RNA. In response to DSBs, endogenous DNA repair processes mostly result in random insertions or deletions (indels) at the site of DNA cleavage through non-homologous end joining (NHEJ). In the presence of a homologous DNA template, the DNA surrounding the cleavage site can be replaced through homology-directed repair (HDR). When simple disruption of a disease-associated gene is sufficient (for example, to treat some gain-of-function diseases), targeted DNA cleavage followed by indel formation can be effective. For most known genetic diseases, however, correction of a point mutation in the target locus, rather than stochastic disruption of the gene, is needed to address or study the underlying cause of the disease.[68]

Motivated by this need, researchers have invested intense effort to increase the efficiency of HDR and suppress NHEJ. For example, a small-molecule inhibitor of ligase IV, an essential enzyme in the NHEJ pathway, has been shown to increase HDR efficiency.[42,43] However, this strategy is challenging in post-mitotic cells, which typically down-regulate HDR, and its therapeutic relevance is limited by the potential risks of inhibiting ligase IV in non-target cells. Enhanced HDR efficiency can also be achieved by the timed delivery of Cas9-guide RNA complexes into chemically synchronized cells, as HDR efficiency is highly cell-cycle dependent.[44] Such an approach, however, is limited to research applications in cell culture since synchronizing cells is highly disruptive. Despite these developments, current strategies to replace point mutations using HDR in most contexts are very inefficient (typically ~0.1 to 5%),[42,43,45,46,75] especially in unmodified, non-dividing cells. In addition, HDR competes with NHEJ during the resolution of double-stranded breaks, and indels are generally more abundant outcomes than gene replacement. These observations highlight the need to develop alternative approaches to install specific modifications in genomic DNA that do not rely on creating double-stranded DNA breaks. A small-molecule inhibitor of ligase IV, an essential enzyme in the NHEJ pathway, has been shown to increase HDR efficiency.[42,43] However, this strategy is challenging in post-mitotic cells, which typically down-regulate HDR, and its therapeutic relevance is limited by the potential risks of inhibiting ligase IV in non-target cells. Enhanced HDR efficiency can also be achieved by the timed delivery of Cas9-guide RNA complexes into chemically synchronized cells, as HDR efficiency is highly cell-cycle dependent.[44] Such an approach, however, is limited to research applications in cell culture since synchronizing cells is highly disruptive. In some cases, it is possible to design HDR templates such that the product of successful HDR contains mutations in the PAM sequence and therefore is no longer a substrate for subsequent Cas9 modification, increasing the overall yield of HDR products,[75] although such an approach imposes constraints on the product sequences. Recently, this strategy has been coupled to the use of ssDNA donors that are complementary to the non-target strand and high-efficiency ribonucleoprotein (RNP) delivery to substantially increase the efficiency of HDR, but even in these cases the ratio of HDR to NHEJ outcomes is relatively low (<2).[83]

It was envisioned that direct catalysis of the conversion of one nucleobase to another at a programmable target locus without requiring DNA backbone cleavage could increase the efficiency of gene correction relative to HDR without introducing undesired random indels at the locus of interest. Catalytically dead Cas9 (dCas9), which contains Asp10Ala and His840Ala mutations that inactivate its nuclease activity, retains its ability to bind DNA in a guide RNA-programmed manner but does not cleave the DNA backbone.[16, 47] In principle, conjugation of dCas9 with an enzymatic or chemical catalyst that mediates the direct conversion of one nucleobase to another could enable RNA-programmed nucleobase editing. The deamination of cytosine (C) is catalyzed by cytidine deaminases[29] and results in uracil (U), which has the base pairing properties of thymine (T). dCas9 was fused to cytidine deaminase enzymes in order to test their ability to convert C to U at a guide RNA-specified DNA locus. Most known cytidine deaminases operate on RNA, and the few examples that are known to accept DNA require single-stranded DNA.[48] Recent studies on the dCas9-target DNA complex reveal that at least nine nucleotides of the displaced DNA strand are unpaired upon formation of the Cas9:guide RNA:DNA "R-loop" complex.[12] Indeed, in the structure of the Cas9 R-loop complex the first 11 nucleotides of the protospacer on the displaced DNA strand are disordered, suggesting that their movement is not highly restricted.[76] It has also been speculated that Cas9 nickase-induced mutations at cytosines in the non-template strand might arise from their accessibility by cellular cytidine deaminase enzymes.[77] Recent studies on the dCas9-target DNA complex have revealed that at least 26 bases on the non-template strand are unpaired when Cas9 binds to its target DNA sequence.[49] It was reasoned that a subset of this stretch of single-stranded DNA in the R-loop might serve as a substrate for a dCas9-tethered cytidine deaminase to effect direct, programmable conversion of C to U in DNA (FIG. 11A).

Four different cytidine deaminase enzymes (hAID, hAPOBEC3G, rAPOBEC1, and pmCDA1) were expressed in a mammalian cell lysate-derived in vitro transcription-translation system and evaluated for ssDNA deamination. Of the four enzymes, rAPOBEC1 showed the highest deaminase activity under the tested conditions and was chosen for dCas9 fusion experiments (FIG. 36A). Although appending rAPOBEC1 to the C-terminus of dCas9 abolishes deaminase activity, fusion to the N-terminus of dCas9 preserves deaminase activity on ssDNA at a level comparable to that of the unfused enzyme. Four rAPOBEC1-dCas9 fusions were expressed and purified with linkers of different length and composition (FIG. 36B), and evaluated each fusion for single guide RNA (sgRNA)-programmed dsDNA deamination in vitro (FIGS. 11A to 11C and FIGS. 15A to 15D).

Figure 11A:
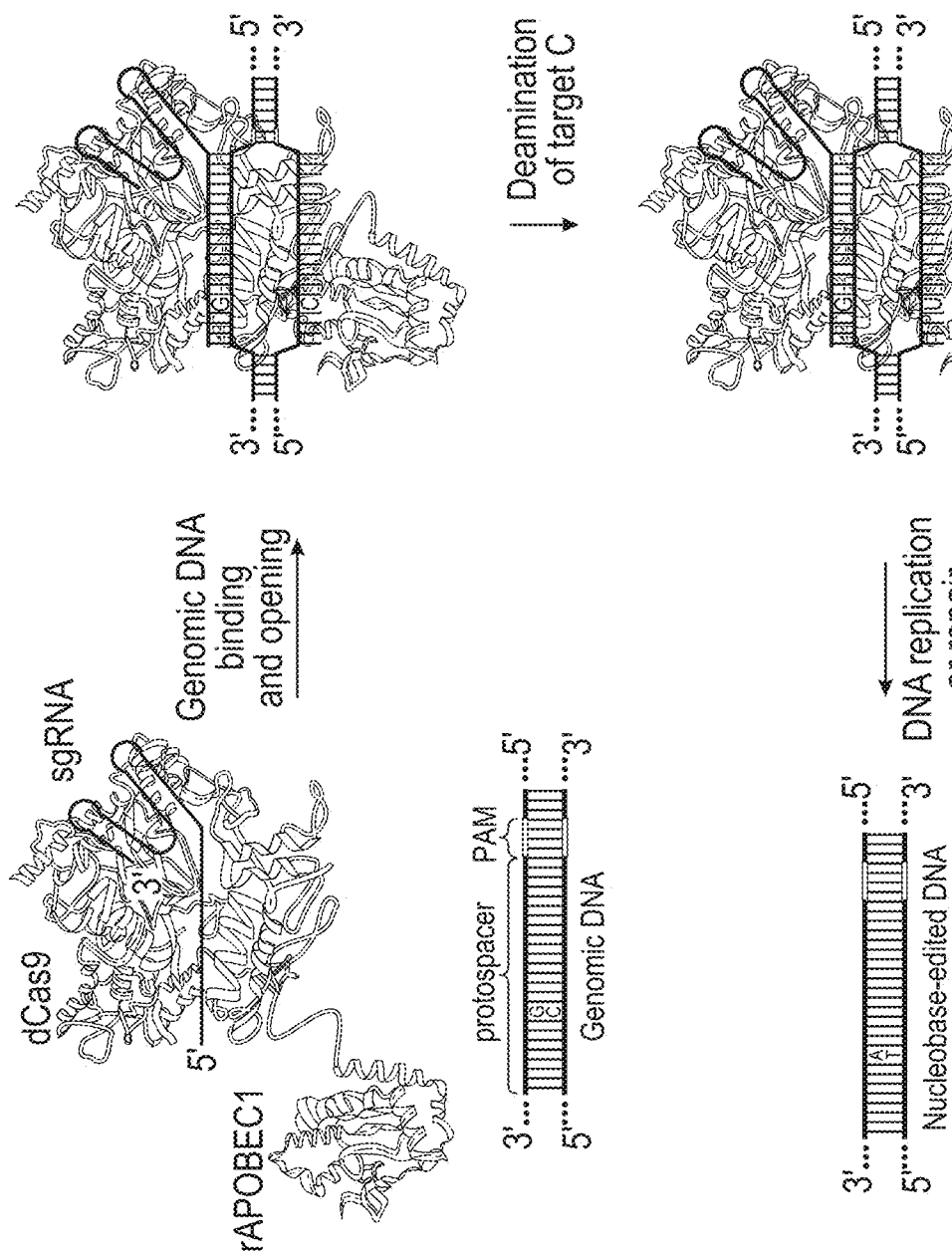

Efficient, sequence-specific, sgRNA-dependent C to U conversion was observed in vitro (FIGS. 11A to 11C). Conversion efficiency was greatest using rAPOBEC1-dCas9 linkers over nine amino acids in length. The number of positions susceptible to deamination (the deamination "activity window") increases with linker length was extended from three to 21 amino acids (FIGS. 36C to 36F 15A to 15D). The 16-residue XTEN linker[50] was found to offer a promising balance between these two characteristics, with an efficient deamination window of approximately five nucleotides, from positions 4 to 8 within the protospacer, counting the end distal to the protospacer-adjacent motif (PAM) as position 1. The rAPOBEC1-XTEN-dCas9 protein served as the first-generation nucleobase editor (NBE1).

Figure 12A:
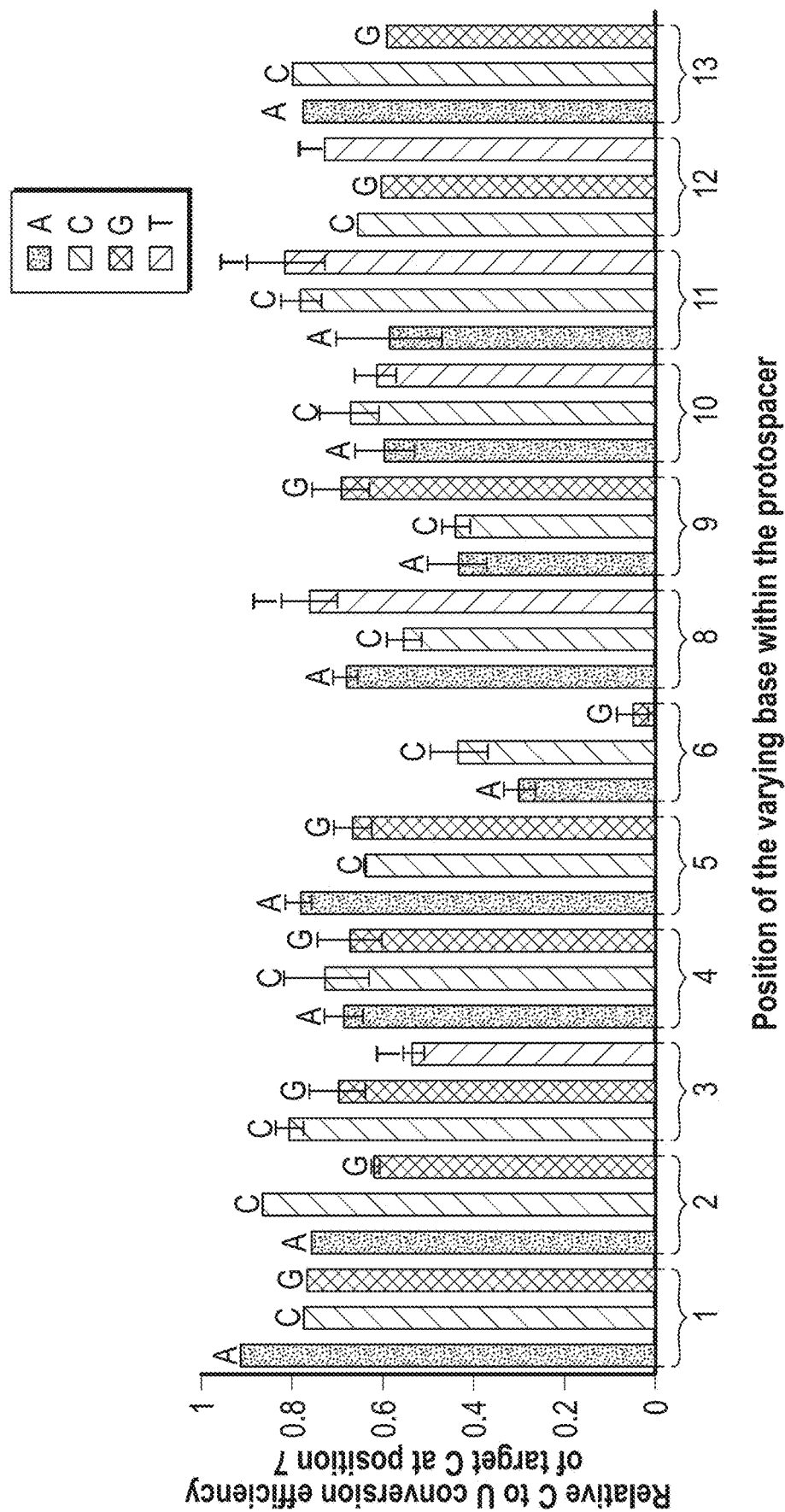
FIGS. 12A to 12B show effects of sequence context and target C position on nucleobase editing efficiency in vitro.
Figure 12B:
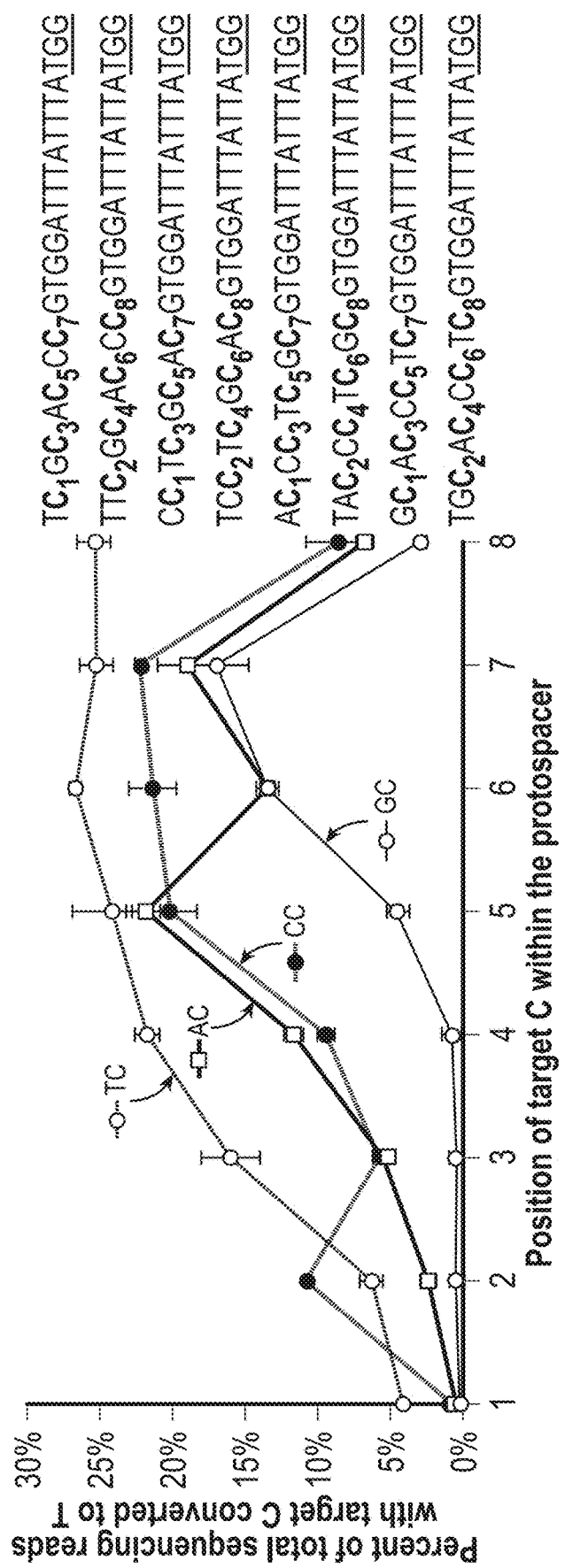

Elected were seven mutations relevant to human disease that in theory could be corrected by C to T nucleobase editing, synthesized double-stranded DNA 80-mers of the corresponding sequences, and assessed the ability of NBE1 to correct these mutations in vitro (FIGS. 16A to 16B). NBE1 yielded products consistent with efficient editing of the target C, or of at least one C within the activity window when multiple Cs were present, in six of these seven targets in vitro, with an average apparent editing efficiency of 44% (FIGS. 16A to 16B). In the three cases in which multiple Cs were present within the deamination window, evidence of deamination of some or all of these cytosines was observed. In only one of the seven cases tested were substantial yields of edited product observed (FIGS. 16A to 16B). Although the preferred sequence context for APOBEC1 substrates is reported to be CC or TC,[51] it was anticipated that the increased effective molarity of the deaminase and its single-stranded DNA substrate mediated by dCas9 binding to the target locus may relax this restriction. To illuminate the sequence context generality of NBE1, its ability to edit a 60-mer double-stranded DNA oligonucleotide containing a single fixed C at position 7 within the protospacer was assayed, as well as all 36 singly mutated variants in which protospacer bases 1-6 and 8-13 were individually varied to each of the other three bases. Each of these 37 sequences were treated with 1.9 µM NBE1, 1.9 µM of the corresponding sgRNA, and 125 nM DNA for 2 h, similar to standard conditions for in vitro Cas9 assays[52]. High-throughput DNA sequencing (HTS) revealed 50 to 80% C to U conversion of targeted strands (25 to 40% of total sequence reads arising from both DNA strands, one of which is not a substrate for NBE1) (FIG. 12A). The nucleotides surrounding the target C had little effect on editing efficiency was independent of sequence context unless the base immediately 5' of the target C is a G, in which case editing efficiency was substantially lower (FIGS. 12A to 12B). NBE1 activity in vitro was assessed on all four NC motifs at positions 1 through 8 within the protospacer (FIGS. 12A to 12B). In general, NBE1 activity on substrates was observed to follow the order TC≥CC≥AC>GC, with maximum editing efficiency achieved when the target C is at or near position 7. In addition, it was observed that the nucleobase editor is highly processive, and will efficiently convert most of all Cs to Us on the same DNA strand within the 5-base activity window (FIG. 17).

While BE1 efficiently processes substrates in a test tube, in cells a tree of possible DNA repair outcomes determines the fate of the initial U:G product of base editing (FIG. 29A). To test the effectiveness of nucleobase editing in human cells, NBE1 codon usage was optimized for mammalian expression, appended a C-terminal nuclear localization sequence (NLS),[53] and assayed its ability to convert C to T in human cells on 14Cs in six well-studied target sites throughout the human genome (FIG. 37A).[54] The editable Cs were confirmed within each protospacer in vitro by incubating NBE1 with synthetic 80-mers that correspond to the six different genomic sites, followed by HTS (FIGS. 13A to 13C, FIG. 29B and FIG. 25). Next, HEK293T cells were transfected with plasmids encoding NBE1 and one of the six target sgRNAs, allowed three days for nucleobase editing to occur, extracted genomic DNA from the cells, and analyzed the loci by HTS. Although C to T editing in cells at the target locus was observed for all six cases, the efficiency of nucleobase editing was 1.1% to 6.3% or 0.8%-7.7% of total DNA sequences (corresponding to 2.2% to 12.6% of targeted strands), a 6.3-fold to 37-fold or 5-fold to 36-fold decrease in efficiency compared to that of in vitro nucleobase editing (FIGS. 13A to 13C, FIG. 29B and FIG. 25). It was observed that some base editing outside of the typical window of positions 4 to 8 when the substrate C is preceded by a T, which we attribute to the unusually high activity of APOBEC1 for TC substrates.[48]

It was asked whether the cellular DNA repair response to the presence of U:G heteroduplex DNA was responsible for the large decrease in nucleobase editing efficiency in cells (FIG. 29A). Uracil DNA glycosylase (UDG) catalyzes removal of U from DNA in cells and initiates base excision repair (BER), with reversion of the U:G pair to a C:G pair as the most common outcome (FIG. 29A).[55] Uracil DNA glycosylase inhibitor (UGI), an 83-residue protein from *B. subtilis* bacteriophage PBS1, potently blocks human UDG activity ($IC_{50}$=12 pM).[56] UGI was fused to the C-terminus of NBE1 to create the second-generation nucleobase editor NBE2 and repeated editing assays on all six genomic loci. Editing efficiencies in human cells were on average 3-fold higher with NBE2 than with NBE1, resulting in gene conversion efficiencies of up to 22.8% of total DNA sequenced (up to 45.6% of targeted strands) (FIGS. 13A to 13C and FIG. 29B). To test base editing in human cells, BE1 codon usage was optimized for mammalian expression and appended a C-terminal nuclear localization sequence (NLS).[53]

Figure 19:
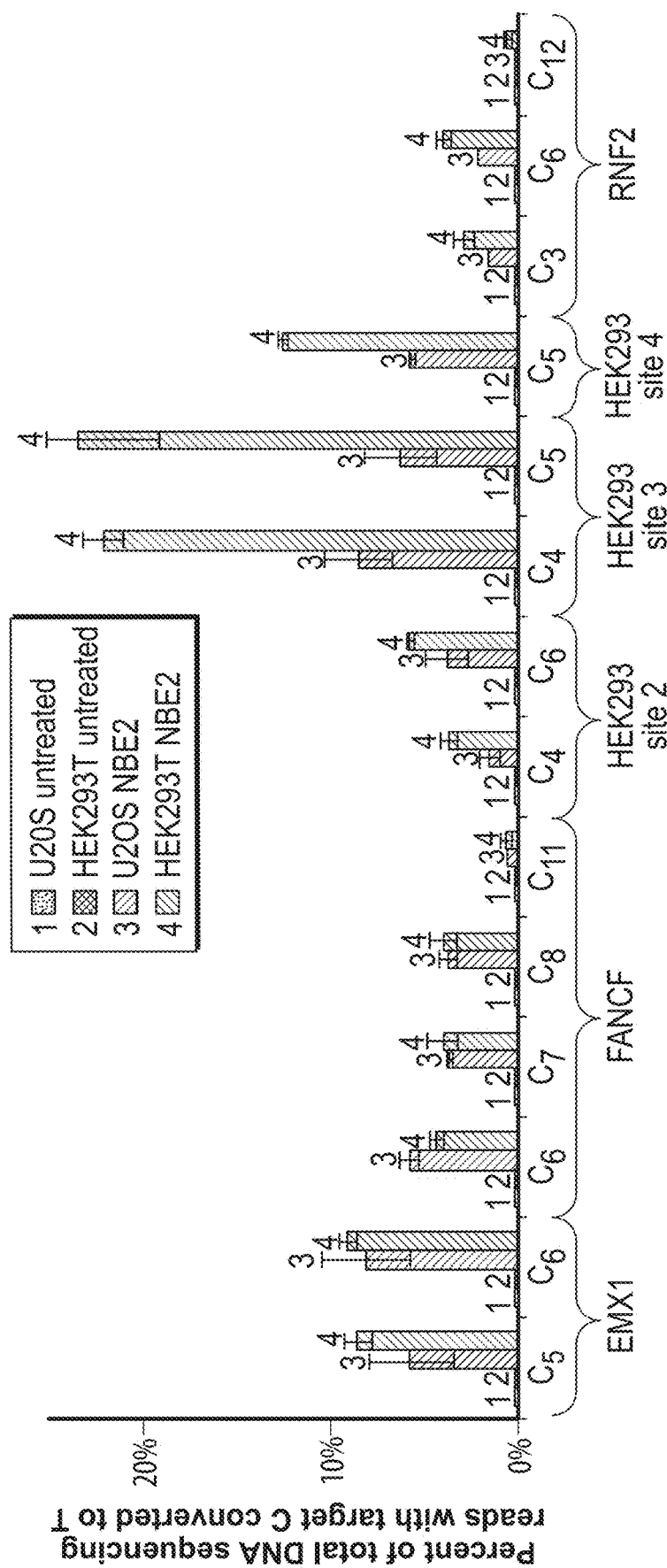

Similar editing efficiencies were observed when a separate plasmid overexpressing UGI was co-transfected with NBE1 (FIGS. 18A to 18H). However, while the direct fusion of UGI to NBE1 resulted in no significant increase in C to T mutations at monitored non-targeted genomic locations, overexpression of unfused UGI detectably increased the frequency of C to T mutations elsewhere in the genome (FIGS. 18A to 18H). The generality of NBE2-mediated nucleobase editing was confirmed by assessing editing efficiencies on the same six genomic targets in U2OS cells, and observed similar results with those in HEK293T cells (FIG. 19). Importantly, NBE2 typically did not result in any detectable indels (FIG. 13C and FIG. 29C), consistent with the known mechanistic dependence of NHEJ on double-stranded DNA breaks.[57, 78] Together, these results indicate that conjugating UGI to NBE1 can greatly increase the efficiency of nucleobase editing in human cells.

The permanence of nucleobase editing in human cells was confirmed by monitoring editing efficiencies over multiple cell divisions in HEK293T cells at two of the tested genomic loci. Genomic DNA was harvested at two time points: three days after transfection with plasmids expressing NBE2 and appropriate sgRNAs, and after passaging the cells and growing them for four additional days (approximately five subsequent cell divisions). No significant change in editing efficiency was observed between the non-passaged cells (editing observed in 4.6% to 6.6% of targeted strands for three different target Cs) and passaged cells (editing observed in 4.6% to 6.4% of targeted strands for the same three target Cs), confirming that the nucleobase edits became permanent following cell division (FIG. 20). Indels will on rare occasion arise from the processing of U:G lesions by cellular repair processes, which involve single-strand break intermediates that are known to lead to indels.[84] Given that several hundred endogenous U:G lesions are generated every day per human cell from spontaneous cytidine deaminase,[85] it was anticipate that the total indel frequency from U:G lesion repair is unlikely to increase from BE1 or BE2 activity at a single target locus.

Figure 13B:
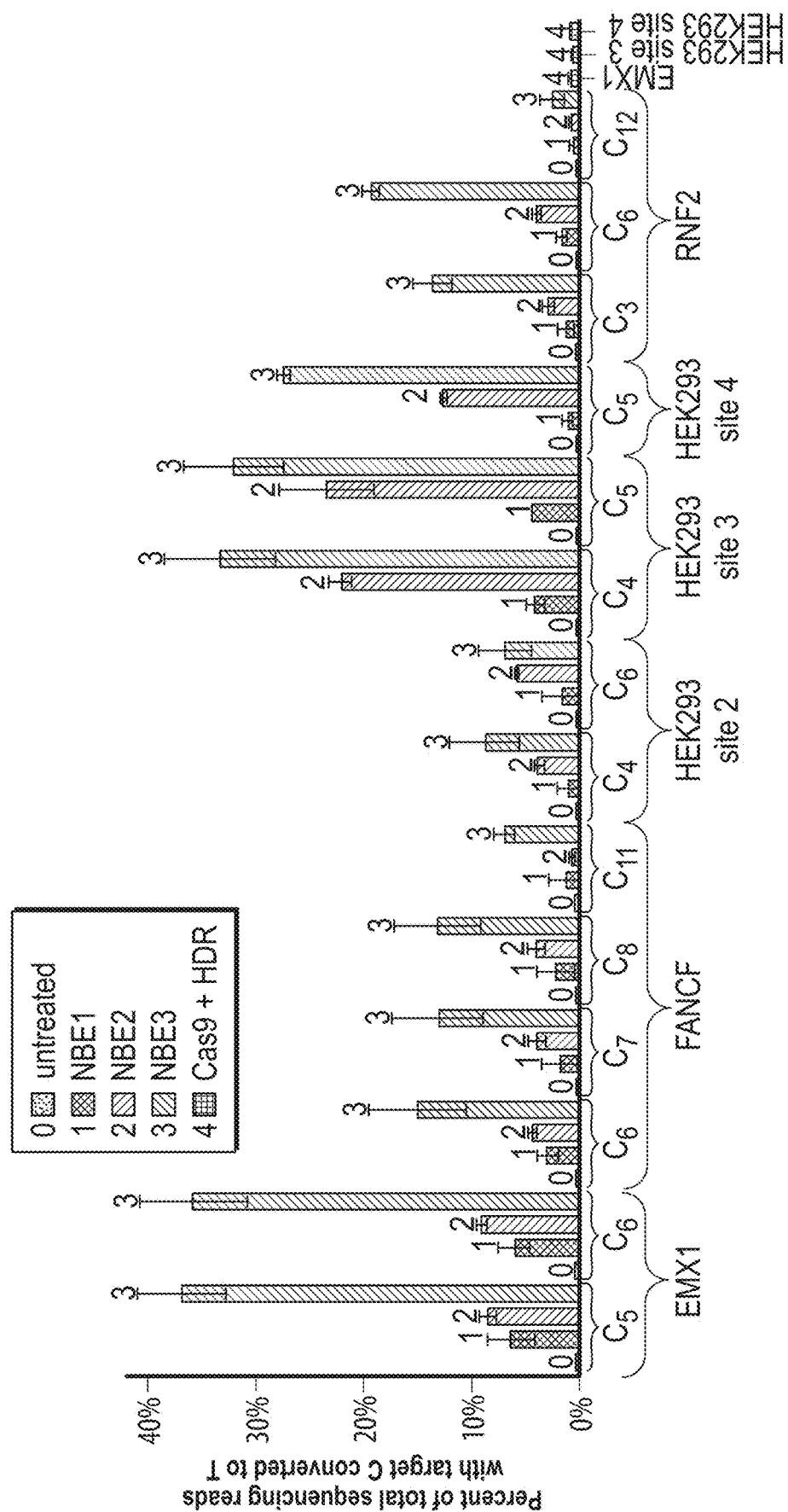
Figure 13C:
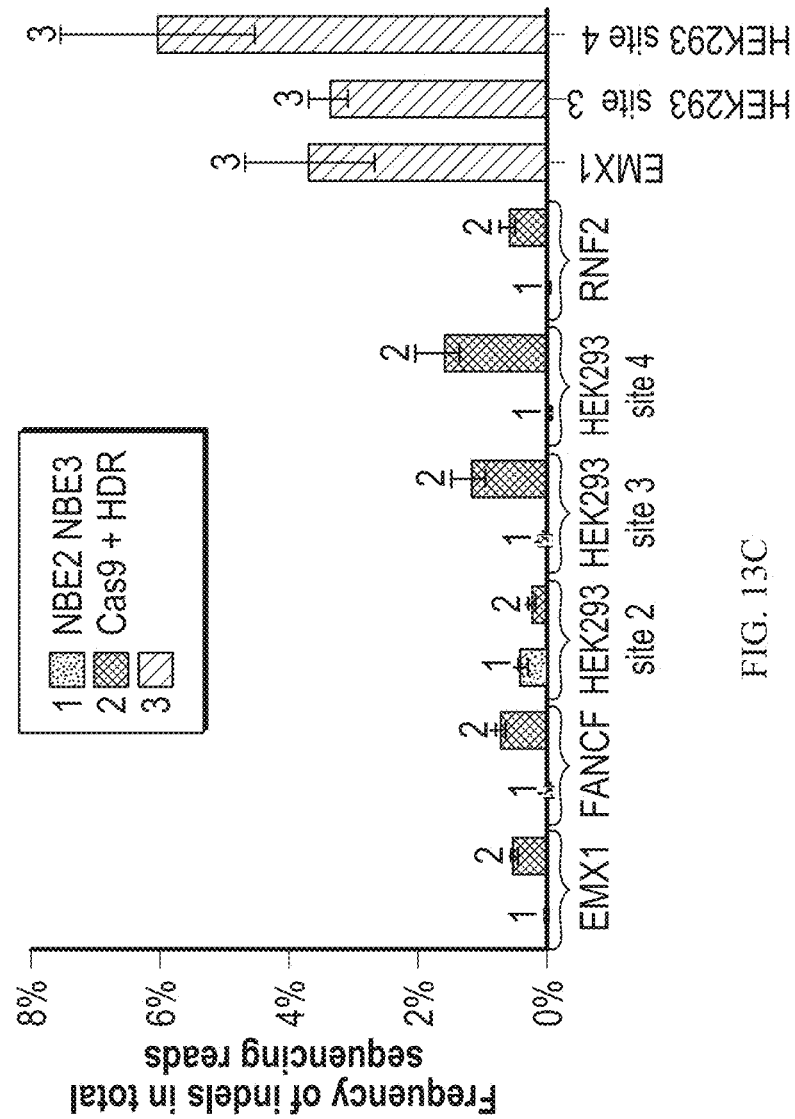
Figure 15A:
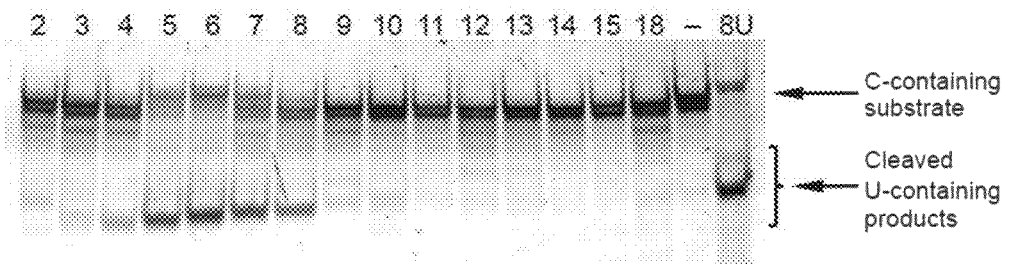
FIGS. 15A to 15D show effects of deaminase-dCas9 linker length and composition on nucleobase editing. Gel-based deaminase assay showing the deamination window of nucleobase editors with deaminase-Cas9 linkers of GGS (FIG. 15A), (GGS)$_3$ (SEQ ID NO: 610) (FIG. 15B), XTEN (FIG. 15C), or (GGS)$_7$ (SEQ ID NO: 610) (FIG. 15D). Following incubation of 1.85 M editor-sgRNA complexes with 125 nM dsDNA substrates at 37° C. for 2 h, the dye-conjugated DNA was isolated and incubated with USER enzyme (uracil DNA glycosylase and endonuclease VIII) at 37° C. for an additional hour to cleave the DNA backbone at the site of any uracils. The resulting DNA was resolved on a denaturing polyacrylamide gel, and the dye-conjugated strand was imaged. Each lane is numbered according to the position of the target C within the protospacer, or with - if no target C is present. 8U is a positive control sequence with a U synthetically incorporated at position 8.
Figure 15B:
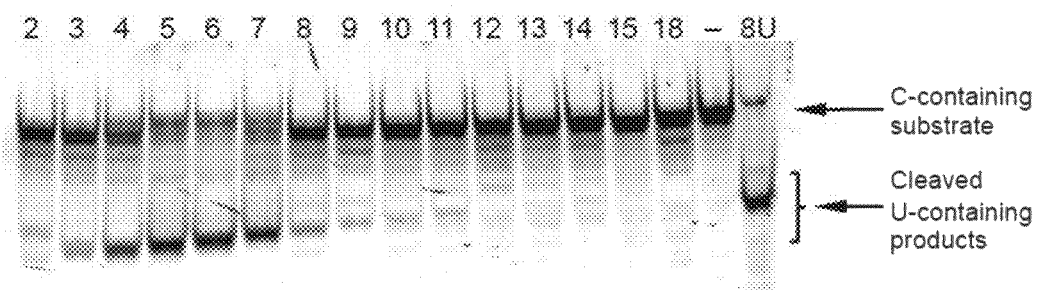
Figure 15C:
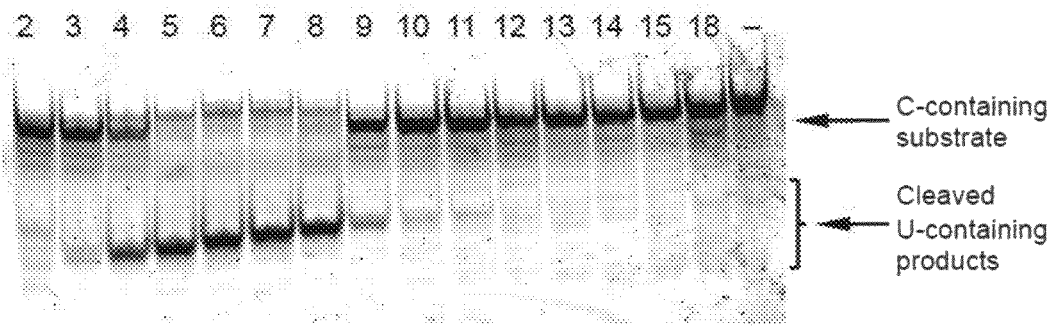
Figure 15D:
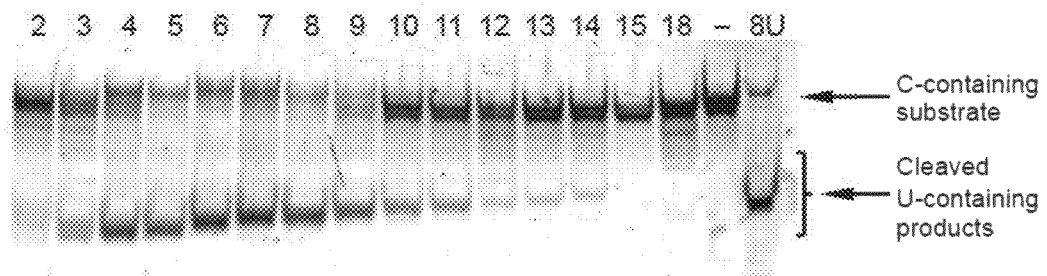

To further increase the efficiency of nucleobase editing in cells, it was anticipated that nicking the non-edited strand may result in a smaller fraction of edited Us being removed by the cell, since eukaryotic mismatch repair machinery uses strand discontinuity to direct DNA repair to any broken strand of a mismatched duplex (FIG. 29A).[58, 79, 80] The catalytic His residue was restored at position 840 in the Cas9 HNH domain,[47,59] resulting in the third-generation nucleobase editor NBE3 that nicks the non-edited strand containing a G opposite the targeted C, but does not cleave the target strand containing the C. Because NBE3 still contains the Asp10Ala mutation in Cas9, it does not induce double-stranded DNA cleavage. This strategy of nicking the non-edited strand augmented nucleobase editing efficiency in human cells by an additional 1.4- to 4.8-fold relative to NBE2, resulting in up to 36.3% of total DNA sequences containing the targeted C to T conversion on the same six human genomic targets in HEK293T cells (FIGS. 13A to 13C and FIG. 29B). Importantly, only a small frequency of indels, averaging 0.8% (ranging from 0.2% to 1.6% for the six different loci), was observed from NBE3 treatment (FIG. 13C, FIG. 29C, and FIG. 34). In contrast, when cells were treated with wild-type Cas9, sgRNA, and a single-stranded DNA donor template to mediate HDR at three of these loci C to T conversion efficiencies averaging only 0.7% were observed, with much higher relative indel formation averaging 3.9% (FIGS. 13A to 13C and FIG. 29C). The ratio of allele conversion to NHEJ outcomes averaged >1,000 for BE2, 23 for BE3, and 0.17 for wild-type Cas9 (FIG. 3c). We confirmed the permanence of base editing in human cells by monitoring editing efficiencies over multiple cell divisions in HEK293T cells at the HEK293 site 3 and 4 genomic loci (FIG. 38). These results collectively establish that nucleobase editing can effect much more efficient targeted single-base editing in human cells than Cas9-mediated HDR, and with much less (NBE3) or no (NBE2) indel formation.

Next, the off-target activity of NBE1, NBE2, and NBE3 in human cells was evaluated. The off-target activities of Cas9, dCas9, and Cas9 nickase have been extensively studied (FIGS. 23 to 24 and 31 to 33).[54,60-62] Because the sequence preference of rAPOBEC1 has been shown to be independent of DNA bases more than one base from the target C,[63] consistent with the sequence context independence observed in FIGS. 12A to 12B, it was assumed that potential off-target activity of nucleobase editors arises from off-target Cas9 binding. Since only a fraction of Cas9 off-target sites will have a C within the active window for nucleobase editing, off-target nucleobase editing sites should be a subset of the off-target sites of canonical Cas9 variants. For each of the six sites studied, the top ten known Cas9 off-target loci in human cells that were previously determined using the GUIDE-seq method were sequenced (FIGS. 23 to 27 and 31 to 33).[54, 61] Detectable off-target nucleobase editing at only a subset (16/34, 47% for NBE1 and NBE2, and 17/34, 50% for NBE3) of known dCas9 off-target loci was observed. In all cases, the off-target base-editing substrates contained a C within the five-base target window. In general, off-target C to T conversion paralleled off-target Cas9 nuclease-mediated genome modification frequencies (FIGS. 23 to 27). Also monitored were C to T conversions at 2,500 distinct cytosines surrounding the six on-target and 34 off-target loci tested, representing a total of 14,700,000 sequence reads derived from approximately 1.8×10[6] cells, and observed no detectable increase in C to T conversions at any of these other sites upon NBE1, NBE2, or NBE3 treatment compared to that of untreated cells (FIG. 28). Taken together, these findings suggest that off-target substrates of nucleobase editors include a subset of Cas9 off-target substrates, and that nucleobase editors in human cells do not induce untargeted C to T conversion throughout the genome at levels that can be detected by the methods used here. No substantial change was observed in editing efficiency between non-passaged HEK293T cells (editing observed in 1.8% to 2.6% of sequenced strands for the three target Cs with BE2, and 6.2% to 14.3% with BE3) and cells that had undergone approximately five cell divisions after base editing (editing observed in 1.9% to 2.3% of sequenced strands for the same target Cs with BE2, and 6.4% to 14.5% with BE3), confirming that base edits in these cells are durable (Extended Data FIG. 6).

Finally, the potential of nucleobase editing to correct three disease-relevant mutations in mammalian cells was tested. The apolipoprotein E gene variant APOE4 encodes two Arg residues at amino acid positions 112 and 158, and is the largest and most common genetic risk factor for late-onset Alzheimer's disease.[64] ApoE variants with Cys residues in positions 112 or 158, including APOE2 (Cys112/Cys158), APOE3 (Cys112/Arg158), and APOE3' (Arg112/Cys158) have been shown[65] or are presumed[81] to confer substantially lower Alzheimer's disease risk than APOE4. Encouraged by the ability of NBE1 to convert APOE4 to APOE3' in vitro (FIGS. 16A to 16B), this conversion was attempted in immortalized mouse astrocytes in which the endogenous murine APOE gene has been replaced by human APOE4 (Taconic). DNA encoding NBE3 and an appropriate sgRNA was delivered into these astrocytes by nucleofection (nucleofection efficiency of 25%), extracted genomic DNA from all treated cells two days later, and measured editing efficiency by HTS. Conversion of Arg158 to Cys158 was observed in 58-75% of total DNA sequencing reads (44% of nucleofected astrocytes) (FIGS. 14A to 14C and FIG. 30A). Also observed was 36-50% editing of total DNA at the third position of codon 158 and 38-55% editing of total DNA at the first position of Leu159, as expected since all three of these Cs are within the active nucleobase editing window. However, neither of the other two C→T conversions results in a change in the amino acid sequence of the ApoE3' protein since both TGC and TGT encode Cys, and both CTG and TTG encode Leu. From >1,500,000 sequencing reads derived from 1×10[6] cells evidence of 1.7% indels at the targeted locus following NBE3 treatment was observed (FIG. 35). In contrast, identical treatment of astrocytes with wt Cas9 and donor ssDNA resulted in 0.1-0.3% APOE4 correction and 26-40% indels at the targeted locus, efficiencies consistent with previous reports of single-base correction using Cas9 and HDR[45,75] (FIG. 30A and FIG. 40A). Astrocytes treated identically but with an sgRNA targeting the VEGFA locus displayed no evidence of APOE4 base editing (FIG. 34 and FIG. 40A). These results demonstrate how nucleobase editors can effect precise, single-amino acid changes in the coding sequence of a protein as the major product of editing, even when their processivity results in more than one nucleotide change in genomic DNA. The off-target activities of Cas9, dCas9, and Cas9 nickase have been extensively studied.[54,60-62] In general, off-target C to T conversions by BE1, BE2, and BE3 paralleled off-target Cas9 nuclease-mediated genome modification frequencies.

The dominant-negative p53 mutations Tyr163Cys and Asn239Asp are strongly associated with several types of cancer.[66-67] Both of these mutations can be corrected by a C to T conversion on the template strand (FIGS. 16A to 16B). A human breast cancer cell line homozygous for the p53 Tyr163Cys mutation (HCC1954 cells) was nucleofected with DNA encoding NBE3 and an sgRNA programmed to correct Tyr163Cys. Because the nucleofection efficiency of HCC1954 cells was <10%, a plasmid expressing IRFP was co-nucleofected into these cells to enable isolation of nucleofected cells by fluorescence-activated cell sorting two days after treatment. HTS of genomic DNA revealed correction of the Tyr163Cys mutation in 7.6% of nucleofected HCC1954 cells (FIG. 30B and FIG. 40A to 40B). Also nucleofected was a human lymphoma cell line that is heterozygous for p53 Asn239Asp (ST486 cells) with DNA encoding NBE2 and an sgRNA programmed to correct Asn239Asp with 92% nucleofection efficiency). Correction of the Asn239Asp mutation was observed in 11% of treated ST486 cells (12% of nucleofected ST486 cells). Consistent with the findings in HEK cells, no indels were observed from the treatment of ST486 cells with NBE2, and 0.6% indel formation from the treatment of HCC1954 cells with NBE3. No other DNA changes within at least 50 base pairs of both sides of the protospacer were detected at frequencies above that of untreated controls out of >2,000,000 sequencing reads derived from $2 \times 10^5$ cells (FIGS. 14A to 14C, FIG. 30B). These results collectively represent the conversion of three disease-associated alleles in genomic DNA into their wild-type forms with an efficiency and lack of other genome modification events that is, to our knowledge, not currently achievable using other methods.

To illuminate the potential relevance of nucleobase editors to address human genetic diseases, the NCBI ClinVar database[68] was searched for known genetic diseases that could in principle be corrected by this approach. ClinVar was filtered by first examining only single nucleotide polymorphisms (SNPs), then removing any nonpathogenic variants. Out of the 24,670 pathogenic SNPs, 3,956 are caused by either a T to C, or an A to G, substitution. This list was further filtered to only include variants with a nearby NGG PAM that would position the SNP within the deamination activity window, resulting in 1,089 clinically relevant pathogenic gene variants that could in principle be corrected by the nucleobase editors described here (FIG. 21).

In some embodiments, any of the base editors provided herein may be used to treat a disease or disorder. For example, any base editors provided herein may be used to correct one or more mutations associated with any of the diseases or disorders provided herein. Exemplary diseases or disorders that may be treated include, without limitation, 3-Methylglutaconic aciduria type 2, 46,XY gonadal dysgenesis, 4-Alpha-hydroxyphenylpyruvate hydroxylase deficiency, 6-pyruvoyl-tetrahydropterin synthase deficiency, achromatopsia, Acid-labile subunit deficiency, Acrodysostosis, acroerythrokeratoderma, ACTH resistance, ACTH-independent macronodular adrenal hyperplasia, Activated PI3K-delta syndrome, Acute intermittent porphyria, Acute myeloid leukemia, Adams-Oliver syndrome 1/5/6, Adenylosuccinate lyase deficiency, Adrenoleukodystrophy, Adult neuronal ceroid lipofuscinosis, Adult onset ataxia with oculomotor apraxia, Advanced sleep phase syndrome, Age-related macular degeneration, Alagille syndrome, Alexander disease, Allan-Herndon-Dudley syndrome, Alport syndrome, X-linked recessive, Alternating hemiplegia of childhood, Alveolar capillary dysplasia with misalignment of pulmonary veins, Amelogenesis imperfecta, Amyloidogenic transthyretin amyloidosis, Amyotrophic lateral sclerosis, Anemia (nonspherocytic hemolytic, due to G6PD deficiency), Anemia (sideroblastic, pyridoxine-refractory, autosomal recessive), Anonychia, Antithrombin III deficiency, Aortic aneurysm, Aplastic anemia, Apolipoprotein C2 deficiency, Apparent mineralocorticoid excess, Aromatase deficiency, Arrhythmogenic right ventricular cardiomyopathy, Familial hypertrophic cardiomyopathy, Hypertrophic cardiomyopathy, Arthrogryposis multiplex congenital, Aspartylglycosaminuria, Asphyxiating thoracic dystrophy, Ataxia with vitamin E deficiency, Ataxia (spastic), Atrial fibrillation, Atrial septal defect, atypical hemolytic-uremic syndrome, autosomal dominant CD11C+/CD1C+ dendritic cell deficiency, Autosomal dominant progressive external ophthalmoplegia with mitochondrial DNA deletions, Baraitser-Winter syndrome, Bartter syndrome, Basa ganglia calcification, Beckwith-Wiedemann syndrome, Benign familial neonatal seizures, Benign scapuloperoneal muscular dystrophy, Bernard Soulier syndrome, Beta thalassemia intermedia, Beta-D-mannosidosis, Bietti crystalline corneoretinal dystrophy, Bile acid malabsorption, Biotinidase deficiency, Borjeson-Forssman-Lehmann syndrome, Boucher Neuhauser syndrome, Bowen-Conradi syndrome, Brachydactyly, Brown-Vialetto-Van laere syndrome, Brugada syndrome, Cardiac arrhythmia, Cardiofaciocutaneous syndrome, Cardiomyopathy, Carnevale syndrome, Carnitine palmitoyltransferase II deficiency, Carpenter syndrome, Cataract, Catecholaminergic polymorphic ventricular tachycardia, Central core disease, Centromeric instability of chromosomes 1,9 and 16 and immunodeficiency, Cerebral autosomal dominant arteriopathy, Cerebro-oculo-facio-skeletal syndrome, Ceroid lipofuscinosis, Charcot-Marie-Tooth disease, Cholestanol storage disease, Chondrocalcinosis, Chondrodysplasia, Chronic progressive multiple sclerosis, Coenzyme Q10 deficiency, Cohen syndrome, Combined deficiency of factor V and factor VIII, Combined immunodeficiency, Combined oxidative phosphorylation deficiency, Combined partial 17-alpha-hydroxylase/17,20-lyase deficiency, Complement factor d deficiency, Complete combined 17-alpha-hydroxylase/17,20-lyase deficiency, Cone-rod dystrophy, Congenital contractural arachnodactyly, Congenital disorder of glycosylation, Congenital lipomatous overgrowth, Neoplasm of ovary, PIK3CA Related Overgrowth Spectrum, Congenital long QT syndrome, Congenital muscular dystrophy, Congenital muscular hypertrophy-cerebral syndrome, Congenital myasthenic syndrome, Congenital myopathy with fiber type disproportion, Eichsfeld type congenital muscular dystrophy, Congenital stationary night blindness, Corneal dystrophy, Cornelia de Lange syndrome, Craniometaphyseal dysplasia, Crigler Najjar syndrome, Crouzon syndrome, Cutis laxa with osteodystrophy, Cyanosis, Cystic fibrosis, Cystinosis, Cytochrome-c oxidase deficiency, Mitochondrial complex I deficiency, D-2-hydroxyglutaric aciduria, Danon disease, Deafness with labyrinthine aplasia microtia and microdontia (LAMM), Deafness, Deficiency of acetyl-CoA acetyltransferase, Deficiency of ferroxidase, Deficiency of UDPglucose-hexose-1-phosphate uridylyltransferase, Dejerine-Sottas disease, Desbuquois syndrome, DFNA, Diabetes mellitus type 2, Diabetes-deafness syndrome, Diamond-Blackfan anemia, Diastrophic dysplasia, Dihydropteridine reductase deficiency, Dihydropyrimidinase deficiency, Dilated cardiomyopathy, Disseminated atypical mycobacterial infection, Distal arthrogryposis, Distal hereditary motor neuronopathy, Donnai Barrow syndrome, Duchenne muscular dystrophy, Becker muscular dystrophy, Dyschromatosis universalis hereditaria, Dyskeratosis congenital, Dystonia, Early infantile epileptic encephalopathy, Ehlers-Danlos syndrome, Eichsfeld type congenital muscular dystrophy, Emery-Dreifuss muscular dystrophy, Enamel-renal syndrome, Epidermolysis bullosa dystrophica inversa, Epidermolysis bullosa herpetiformis, Epilepsy, Episodic ataxia, Erythrokeratodermia variabilis, Erythropoietic protoporphyria, Exercise intolerance, Exudative vitreoretinopathy, Fabry disease, Factor V deficiency, Factor VII deficiency, Factor xiii deficiency, Familial adenomatous polyposis, breast cancer, ovarian cancer, cold urticarial, chronic infantile neurological, cutaneous and articular syndrome, hemiplegic migraine, hypercholesterolemia, hypertrophic cardiomyopathy, hypoalphalipoproteinemia, hypokalemia-hypomagnesemia, juvenile gout, hyperlipoproteinemia, visceral amyloidosis, hypophosphatemic vitamin D refractory rickets, FG syndrome, Fibrosis of extraocular muscles, Finnish congenital nephrotic syndrome, focal epilepsy, Focal segmental glomerulosclerosis, Frontonasal dysplasia, Frontotemporal dementia, Fructose-biphosphatase deficiency, Gamstorp-Wohlfart syndrome, Ganglioside sialidase deficiency, GATA-1-related thrombocytopenia, Gaucher disease, Giant axonal neuropathy, Glanzmann thrombasthenia, Glomerulocystic kidney disease, Glomerulopathy, Glucocorticoid resistance, Glucose-6-phosphate transport defect, Glutaric aciduria, Glycogen storage disease, Gorlin syndrome, Holoprosencephaly, GRACILE syndrome, Haemorrhagic telangiectasia, Hemochromatosis, Hemoglobin H disease, Hemolytic anemia, Hemophagocytic lymphohistiocytosis, Carcinoma of colon, Myhre syndrome, leukoencephalopathy, Hereditary factor IX deficiency disease, Hereditary factor VIII deficiency disease, Hereditary factor XI deficiency disease, Hereditary fructosuria, Hereditary Nonpolyposis Colorectal Neoplasm, Hereditary pancreatitis, Hereditary pyropoikilocytosis, Elliptocytosis, Heterotaxy, Heterotopia, Histiocytic medullary reticulosis, Histiocytosis-lymphadenopathy plus syndrome, HNSHA due to aldolase A deficiency, Holocarboxylase synthetase deficiency, Homocysteinemia, Howel-Evans syndrome, Hydatidiform mole, Hypercalciuric hypercalcemia, Hyperimmunoglobulin D, Mevalonic aciduria, Hyperinsulinemic hypoglycemia, Hyperkalemic Periodic Paralysis, Paramyotonia congenita of von Eulenburg, Hyperlipoproteinemia, Hypermanganesemia, Hypermethioninemia, Hyperphosphatasemia, Hypertension, hypomagnesemia, Hypobetalipoproteinemia, Hypocalcemia, Hypogonadotropic hypogonadism, Hypogonadotropic hypogonadism, Hypohidrotic ectodermal dysplasia, Hyper-IgM immunodeficiency, Hypohidrotic X-linked ectodermal dysplasia, Hypomagnesemia, Hypoparathyroidism, Idiopathic fibrosing alveolitis, Immunodeficiency, Immunoglobulin A deficiency, Infantile hypophosphatasia, Infantile Parkinsonism-dystonia, Insulin-dependent diabetes mellitus, Intermediate maple syrup urine disease, Ischiopatellar dysplasia, Islet cell hyperplasia, Isolated growth hormone deficiency, Isolated lutropin deficiency, Isovaleric acidemia, Joubert syndrome, Juvenile polyposis syndrome, Juvenile retinoschisis, Kallmann syndrome, Kartagener syndrome, Kugelberg-Welander disease, Lattice corneal dystrophy, Leber congenital amaurosis, Leber optic atrophy, Left ventricular noncompaction, Leigh disease, Mitochondrial complex I deficiency, Leprechaunism syndrome, Arthrogryposis, Anterior horn cell disease, Leukocyte adhesion deficiency, Leukodystrophy, Leukoencephalopathy, Ovarioleukodystrophy, L-ferritin deficiency, Li-Fraumeni syndrome, Limbgirdle muscular dystrophy-dystroglycanopathy, Loeys-Dietz syndrome, Long QT syndrome, Macrocephaly/autism syndrome, Macular corneal dystrophy, Macular dystrophy, Malignant hyperthermia susceptibility, Malignant tumor of prostate, Maple syrup urine disease, Marden Walker like syndrome, Marfan syndrome, Marie Unna hereditary hypotrichosis, Mast cell disease, Meconium ileus, Medium-chain acyl-coenzyme A dehydrogenase deficiency, Melnick-Fraser syndrome, Mental retardation, Merosin deficient congenital muscular dystrophy, Mesothelioma, Metachromatic leukodystrophy, Metaphyseal chondrodysplasia, Methemoglobinemia, methylmalonic aciduria, homocystinuria, Microcephaly, chorioretinopathy, lymphedema, Microphthalmia, Mild non-PKU hyperphenylalanemia, Mitchell-Riley syndrome, mitochondrial 3-hydroxy-3-methylglutaryl-CoA synthase deficiency, Mitochondrial complex I deficiency, Mitochondrial complex III deficiency, Mitochondrial myopathy, Mucolipidosis III, Mucopolysaccharidosis, Multiple sulfatase deficiency, Myasthenic syndrome, *Mycobacterium tuberculosis*, Myeloperoxidase deficiency, Myhre syndrome, Myoclonic epilepsy, Myofibrillar myopathy, Myoglobinuria, Myopathy, Myopia, Myotonia congenital, Navajo neurohepatopathy, Nemaline myopathy, Neoplasm of stomach, Nephrogenic diabetes insipidus, Nephronophthisis, Nephrotic syndrome, Neurofibromatosis, Neutral lipid storage disease, Niemann-Pick disease, Non-ketotic hyperglycinemia, Noonan syndrome, Noonan syndrome-like disorder, Norum disease, Macular degeneration, N-terminal acetyltransferase deficiency, Oculocutaneous albinism, Oculodentodigital dysplasia, Ohdo syndrome, Optic nerve aplasia, Ornithine carbamoyltransferase deficiency, Orofaciodigital syndrome, Osteogenesis imperfecta, Osteopetrosis, Ovarian dysgenesis, Pachyonychia, Palmoplantar keratoderma, nonepidermolytic, Papillon-Lef\xc3\xa8vre syndrome, Haim-Munk syndrome, Periodontitis, Peeling skin syndrome, Pendred syndrome, Peroxisomal fatty acyl-coa reductase 1 disorder, Peroxisome biogenesis disorder, Pfeiffer syndrome, Phenylketonuria, Phenylketonuria, Hyperphenylalaninemia, non-PKU, Pituitary hormone deficiency, *Pityriasis rubra* pilaris, *Polyarteritis nodosa*, Polycystic kidney disease, Polycystic lipomembranous osteodysplasia, Polymicrogyria, Pontocerebellar hypoplasia, Porokeratosis, Posterior column ataxia, Primary erythromelalgia, hyperoxaluria, Progressive familial intrahepatic cholestasis, Progressive pseudorheumatoid dysplasia, Propionic acidemia, Pseudohermaphroditism, Pseudohypoaldosteronism, Pseudoxanthoma elasticum-like disorder, Purine-nucleoside phosphorylase deficiency, Pyridoxal 5-phosphate-dependent epilepsy, Renal dysplasia, retinal pigmentary dystrophy, cerebellar ataxia, skeletal dysplasia, Reticular dysgenesis, Retinitis pigmentosa, Usher syndrome, Retinoblastoma, Retinopathy, RRM2B-related mitochondrial disease, Rubinstein-Taybi syndrome, Schnyder crystalline corneal dystrophy, Sebaceous tumor, Severe congenital neutropenia, Severe myoclonic epilepsy in infancy, Severe X-linked myotubular myopathy, onychodysplasia, facial dysmorphism, hypotrichosis, Short-rib thoracic dysplasia, Sialic acid storage disease, Sialidosis, Sideroblastic anemia, Small fiber neuropathy, Smith-Magenis syndrome, Sorsby fundus dystrophy, Spastic ataxia, Spastic paraplegia, Spermatogenic failure, Spherocytosis, Sphingomyelin/cholesterol lipidosis, Spinocerebellar ataxia, Split-hand/foot malformation, Spondyloepimetaphyseal dysplasia, Platyspondylic lethal skeletal dysplasia, Squamous cell carcinoma of the head and neck, Stargardt disease, Sucrase-isomaltase deficiency, Sudden infant death syndrome, Supravalvar aortic stenosis, Surfactant metabolism dysfunction, Tangier disease, Tatton-Brown-rahman syndrome, Thoracic aortic aneurysms and aortic dissections, Thrombophilia, Thyroid hormone resistance, TNF receptor-associated periodic fever syndrome (TRAPS), Tooth agenesis, Torsades de pointes, Transposition of great arteries, Treacher Collins syndrome, Tuberous sclerosis syndrome, Tyrosinase-negative oculocutaneous albinism, Tyrosinase-positive oculocutaneous albinism, Tyrosinemia, UDPglucose-4-epimerase deficiency, Ullrich congenital muscular dystrophy, Bethlem myopathy Usher syndrome, UV-sensitive syndrome, Van der Woude syndrome, popliteal pterygium syndrome, Very long chain acyl-CoA dehydrogenase deficiency, Vesicoureteral reflux, Vitreoretinochoroidopathy, Von Hippel-Lindau syndrome, von Willebrand disease, Waardenburg syndrome, Warsaw breakage syndrome, WFS1-Related Disorders, Wilson disease, Xeroderma pigmentosum, X-linked agammaglobulinemia, X-linked hereditary motor and sensory neuropathy, X-linked severe combined immunodeficiency, and Zellweger syndrome.

The development of nucleobase editing advances both the scope and effectiveness of genome editing. The nucleobase editors described here offer researchers a choice of editing with virtually no indel formation (NBE2), or more efficient editing with a low frequency (here, typically <1%) of indel formation (NBE3). That the product of base editing is, by definition, no longer a substrate likely contributes to editing efficiency by preventing subsequent product transformation, which can hamper traditional Cas9 applications. By removing the reliance on double-stranded DNA cleavage and stochastic DNA repair processes that vary greatly by cell state and cell type, nucleobase editing has the potential to expand the type of genome modifications that can be cleanly installed, the efficiency of these modifications, and the type of cells that are amenable to editing. It is likely that recent engineered Cas9 variants[69,70,82] or delivery methods[71] with improved DNA specificity, as well as Cas9 variants with altered PAM specificities,[72] can be integrated into this strategy to provide additional nucleobase editors with improved DNA specificity or that can target an even wider range of disease-associated mutations. These findings also suggest that engineering additional fusions of dCas9 with enzymes that catalyze additional nucleobase transformations will increase the fraction of the possible DNA base changes that can be made through nucleobase editing. These results also suggest architectures for the fusion of other DNA-modifying enzymes, including methylases and demathylases, that mau enable additional types of programmable genome and epigenome base editing.

Materials and Methods

Cloning. DNA sequences of all constructs and primers used in this paper are listed in the Supplementary Sequences. Plasmids containing genes encoding NBE1, NBE2, and NBE3 will be available from Addgene. PCR was performed using VeraSeq ULtra DNA polymerase (Enzymatics), or Q5 Hot Start High-Fidelity DNA Polymerase (New England Biolabs). NBE plasmids were constructed using USER cloning (New England Biolabs). Deaminase genes were synthesized as gBlocks Gene Fragments (Integrated DNA Technologies), and Cas9 genes were obtained from previously reported plasmids.[18] Deaminase and fusion genes were cloned into pCMV (mammalian codon-optimized) or pET28b (*E. coli* codon-optimized) backbones. sgRNA expression plasmids were constructed using site-directed mutagenesis. Briefly, the primers listed in the Supplementary Sequences were 5' phosphorylated using T4 Polynucleotide Kinase (New England Biolabs) according to the manufacturer's instructions. Next, PCR was performed using Q5 Hot Start High-Fidelity Polymerase (New England Biolabs) with the phosphorylated primers and the plasmid pFYF1320 (EGFP sgRNA expression plasmid) as a template according to the manufacturer's instructions. PCR products were incubated with DpnI (20 U, New England Biolabs) at 37° C. for 1 h, purified on a QIAprep spin column (Qiagen), and ligated using QuickLigase (New England Biolabs) according to the manufacturer's instructions. DNA vector amplification was carried out using Machi competent cells (ThermoFisher Scientific).

In Vitro Deaminase Assay on ssDNA.

Sequences of all ssDNA substrates are listed in the Supplementary Sequences. All Cy3-labelled substrates were obtained from Integrated DNA Technologies (IDT). Deaminases were expressed in vitro using the TNT T7 Quick Coupled Transcription/Translation Kit (Promega) according to the manufacturer's instructions using 1 µg of plasmid. Following protein expression, 5 µL of lysate was combined with 35 µL of ssDNA (1.8 µM) and USER enzyme (1 unit) in CutSmart buffer (New England Biolabs) (50 mM potassium acetate, 29 mM Trisacetate, 10 mM magnesium acetate, 100 ug/mL BSA, pH 7.9) and incubated at 37° C. for 2 h. Cleaved U-containing substrates were resolved from full-length unmodified substrates on a 10% TBE-urea gel (Bio-Rad).

Expression and Purification of His6-rAPOBEC1-Linker-dCas9 Fusions.

*E. Coli* BL21 STAR (DE3)-competent cells (ThermoFisher Scientific) were transformed with plasmids encoding pET28b-His6-rAPOBEC1-linker-dCas9 with GGS, $(GGS)_3$, (SEQ ID NO: 610) XTEN, or $(GGS)_7$ (SEQ ID NO: 610) linkers. The resulting expression strains were grown overnight in Luria-Bertani (LB) broth containing 100 µg/mL of kanamycin at 37° C. The cells were diluted 1:100 into the same growth medium and grown at 37° C. to $OD_{600}$=~0.6. The culture was cooled to 4° C. over a period of 2 h, and isopropyl-β-D-1-thiogalactopyranoside (IPTG) was added at 0.5 mM to induce protein expression. After ~16 h, the cells were collected by centrifugation at 4,000 g and resuspended in lysis buffer (50 mM tris(hydroxymethyl)-aminomethane (Tris)-HCl, pH 7.0, 1 M NaCl, 20% glycerol, 10 mM tris(2-carboxyethyl)phosphine (TCEP, Soltec Ventures)). The cells were lysed by sonication (20 s pulse-on. 20 s pulse-off for 8 min total at 6 W output) and the lysate supernatant was isolated following centrifugation at 25,000 g for 15 min. The lysate was incubated with His-Pur nickel-nitriloacetic acid (nickel-NTA) resin (ThermoFisher Scientific) at 4° C. for 1 h to capture the His-tagged fusion protein. The resin was transferred to a column and washed with 40 mL of lysis buffer. The His-tagged fusion protein was eluted in lysis buffer supplemented with 285 mM imidazole, and concentrated by ultrafiltration (Amicon-Millipore, 100-kDa molecular weight cut-off) to 1 mL total volume. The protein was diluted to 20 mL in low-salt purification buffer containing 50 mM tris(hydroxymethyl)-aminomethane (Tris)-HCl, pH 7.0, 0.1 M NaCl, 20% glycerol. 10 mM TCEP and loaded onto SP Sepharose Fast Flow resin (GE Life Sciences). The resin was washed with 40 mL of this low-salt buffer, and the protein eluted with 5 mL, of activity buffer containing 50 mM tris(hydroxymethyl)-aminomethane (Tris)-HCl, pH 7.0. 0.5 M NaCl, 20% glycerol, 10 mM TCEP. The eluted proteins were quantified on a SDSPAGE gel In Vitro Transcription of sgRNAs.

Linear DNA fragments containing the T7 promoter followed by the 20-bp sgRNA target sequence were transcribed in vitro using the primers listed in the Supplementary Sequences with the TranscriptAid T7 High Yield Transcription Kit (ThermoFisher Scientific) according to the manufacturer's instructions. sgRNA products were purified using the MEGAclear Kit (ThermoFisher Scientific) according to the manufacturer's instructions and quantified by UV absorbance.

Preparation of Cy3-Conjugated dsDNA Substrates.

Sequences of 80-nucleotide unlabeled strands are listed in the Supplementary Sequences and were ordered as PAGE-purified oligonucleotides from IDT. The 25-nt Cy3-labeled primer listed in the Supplementary Sequences is complementary to the 3' end of each 80-nt substrate. This primer was ordered as an HPLC-purified oligonucleotide from IDT. To generate the Cy3-labeled dsDNA substrates, the 80-nt strands (5 µL of a 100 µM solution) were combined with the Cy3-labeled primer (5 L of a 100 µM solution) in NEBuffer 2 (38.25 µL of a 50 mM NaCl, 10 mMTris-HCl, 10 mM $MgCl_2$, 1 mM DTT, pH 7.9 solution, New England Biolabs) with dNTPs (0.75 µL of a 100 mM solution) and heated to 95° C. for 5 min, followed by a gradual cooling to 45° C. at a rate of 0.1° C./s. After this annealing period, Klenow exo (5 U, New England Biolabs) was added and the reaction was incubated at 37° C. for 1 h. The solution was diluted with Buffer PB (250 µL, Qiagen) and isopropanol (50 µL) and purified on a QIAprep spin column (Qiagen), eluting with 50 µL of Tris buffer.

Deaminase Assay on dsDNA.

The purified fusion protein (20 µL of 1.9 µM in activity buffer) was combined with 1 equivalent of appropriate sgRNA and incubated at ambient temperature for 5 min. The Cy3-labeled dsDNA substrate was added to final concentration of 125 nM and the resulting solution was incubated at 37° C. for 2 h. The dsDNA was separated from the fusion by the addition of Buffer PB (100 µL, Qiagen) and isopropanol (25 µL) and purified on a EconoSpin micro spin column (Epoch Life Science), eluting with 20 µL of CutSmart buffer (New England Biolabs). USER enzyme (1 U, New England Biolabs) was added to the purified, edited dsDNA and incubated at 37° C. for 1 h. The Cy3-labeled strand was fully denatured from its complement by combining 5 μL of the reaction solution with 15 μL of a DMSO-based loading buffer (5 mM Tris, 0.5 mM EDTA, 12.5% glycerol, 0.02% bromophenol blue, 0.02% xylene cyan, 80% DMSO). The full-length C-containing substrate was separated from any cleaved, U-containing edited substrates on a 10% TBE-urea gel (Bio-Rad) and imaged on a GE Amersham Typhoon imager.

Preparation of In Vitro-Edited dsDNA for High-Throughput Sequencing (HTS).

The oligonucleotides listed in the Supplementary Sequences were obtained from IDT. Complementary sequences were combined (5 μL of a 100 μM solution) in Tris buffer and annealed by heating to 95° C. for 5 min, followed by a gradual cooling to 45° C. at a rate of 0.1° C./s to generate 60-bp dsDNA substrates. Purified fusion protein (20 μL of 1.9 μM in activity buffer) was combined with 1 equivalent of appropriate sgRNA and incubated at ambient temperature for 5 min. The 60-mer dsDNA substrate was added to final concentration of 125 nM and the resulting solution was incubated at 37° C. for 2 h. The dsDNA was separated from the fusion by the addition of Buffer PB (100 μL, Qiagen) and isopropanol (25 μL) and purified on a EconoSpin micro spin column (Epoch Life Science), eluting with 20 μL of Tris buffer. The resulting edited DNA (1 μL was used as a template) was amplified by PCR using the HTS primer pairs specified in the Supplementary Sequences and VeraSeq Ultra (Enzymatics) according to the manufacturer's instructions with 13 cycles of amplification. PCR reaction products were purified using RapidTips (Diffinity Genomics), and the purified DNA was amplified by PCR with primers containing sequencing adapters, purified, and sequenced on a MiSeq high-throughput DNA sequencer (Illumina) as previously described.[73]

Cell Culture.

HEK293T (ATCC CRL-3216), U2OS (ATCC-HTB-96) and ST486 cells (ATCC) were maintained in Dulbecco's Modified Eagle's Medium plus GlutaMax (ThermoFisher) supplemented with 10% (v/v) fetal bovine serum (FBS) and penicillin/streptomycin (1x, Amresco), at 37° C. with 5% $CO_2$. HCC1954 cells (ATCC CRL-2338) were maintained in RPMI-1640 medium (ThermoFisher Scientific) supplemented as described above. Immortalized rat astrocytes containing the ApoE4 isoform of the APOE gene (Taconic Biosciences) were cultured in Dulbecco's Modified Eagle's Medium plus GlutaMax (ThermoFisher Scientific) supplemented with 10% (v/v) fetal bovine serum (FBS) and 200 g/mL Geneticin (ThermoFisher Scientific).

Transfections.

HEK293T cells were seeded on 48-well collagen-coated BioCoat plates (Corning) and transfected at approximately 85% confluency. Briefly, 750 ng of NBE and 250 ng of sgRNA expression plasmids were transfected using 1.5 μl of LIPOFECTAMINE® 2000 transfection reagent (ThermoFisher Scientific) per well according to the manufacturer's protocol. Astrocytes, U2OS, HCC1954, HEK293T and ST486 cells were transfected using appropriate AMAXA NUCLEOFECTOR™ II programs according to manufacturer's instructions. 40 ng of infrared RFP (Addgene plasmid 45457)[74] was added to the nucleofection solution to assess nucleofection efficiencies in these cell lines. For astrocytes, U2OS, and ST486 cells, nucleofection efficiencies were 25%, 74%, and 92%, respectively. For HCC1954 cells, nucleofection efficiency was <10%. Therefore, following trypsinization, the HCC1954 cells were filtered through a 40 micron strainer (Fisher Scientific), and the nucleofected HCC1954 cells were collected on a Beckman Coulter MoFlo XDP Cell Sorter using the iRFP signal (abs 643 nm, em 670 nm). The other cells were used without enrichment of nucleofected cells.

High-Throughput DNA Sequencing of Genomic DNA Samples.

Transfected cells were harvested after 3 d and the genomic DNA was isolated using the Agencourt DNAdvance Genomic DNA Isolation Kit (Beckman Coulter) according to the manufacturer's instructions. On-target and off-target genomic regions of interest were amplified by PCR with flanking HTS primer pairs listed in the Supplementary Sequences. PCR amplification was carried out with Phusion high-fidelity DNA polymerase (ThermoFisher) according to the manufacturer's instructions using 5 ng of genomic DNA as a template. Cycle numbers were determined separately for each primer pair as to ensure the reaction was stopped in the linear range of amplification (30, 28, 28, 28, 32, and 32 cycles for EMX1, FANCF, HEK293 site 2, HEK293 site 3, HEK293 site 4, and RNF2 primers, respectively). PCR products were purified using RapidTips (Diffinity Genomics). Purified DNA was amplified by PCR with primers containing sequencing adaptors. The products were gel-purified and quantified using the QUANT-IT™ PicoGreen dsDNA Assay Kit (ThermoFisher) and KAPA Library Quantification Kit-Illumina (KAPA Biosystems). Samples were sequenced on an Illumina MiSeq as previously described.[73]

Data Analysis.

Sequencing reads were automatically demultiplexed using MiSeq Reporter (Illumina), and individual FASTQ files were analyzed with a custom Matlab script provided in the Supplementary Notes. Each read was pairwise aligned to the appropriate reference sequence using the Smith-Waterman algorithm. Base calls with a Q-score below 31 were replaced with N's and were thus excluded in calculating nucleotide frequencies. This treatment yields an expected MiSeq base-calling error rate of approximately 1 in 1,000. Aligned sequences in which the read and reference sequence contained no gaps were stored in an alignment table from which base frequencies could be tabulated for each locus.

Indel frequencies were quantified with a custom Matlab script shown in the Supplementary Notes using previously described criteria[71]. Sequencing reads were scanned for exact matches to two 10-bp sequences that flank both sides of a window in which indels might occur. If no exact matches were located, the read was excluded from analysis. If the length of this indel window exactly matched the reference sequence the read was classified as not containing an indel. If the indel window was two or more bases longer or shorter than the reference sequence, then the sequencing read was classified as an insertion or deletion, respectively.

All publications, patents, patent applications, publication, and database entries (e.g., sequence database entries) mentioned herein, e.g., in the Background, Summary, Detailed Description, Examples, and/or References sections, are hereby incorporated by reference in their entirety as if each individual publication, patent, patent application, publication, and database entry was specifically and individually incorporated herein by reference. In case of conflict, the present application, including any definitions herein, will control.

Supplementary Sequences

Primers Used for Generating sgRNA Transfection Plasmids.

rev_sgRNA_plasmid was used in all cases. The pFYF1320 plasmid was used as template as noted in Materials and Methods section. SEQ ID NOs: 187-196 appear from top to bottom below, respectively.

```
rev_sgRNA_plasmid   GGTGTTTCGTCCTTTCCACAAG fxd_p53_Y163C       GCTTGCAGATGGCCATGGCGGTTTTAGAGCTAGAAATAGCAAGTTAAAATAAGGC fwd_p53_N239D       TGTCACACATGTAGTTGTAGGTTTTAGAGCTAGAAATAGCAAGTTAAAATAAGGC fwd_APOE4_C158R     GAAGCGCCTGGCAGTGTACCGTTTTAGAGCTAGAAATAGCAAGTTAAAATAAGGC fwd_EMX1            GAGTCCGAGCAGAAGAAGAAGTTTTAGAGCTAGAAATAGCAAGTTAAAATAAGGC fwd_FANCF           GGAATCCCTTCTGCAGCACCGTTTTAGAGCTAGAAATAGCAAGTTAAAATAAGGC fwd_HEK293_2        GAACACAAAGCATAGACTGCGTTTTAGAGCTAGAAATAGCAAGTTAAAATAAGGC fwd_HEK293_3        GGCCCAGACTGAGCACGTGAGTTTTAGAGCTAGAAATAGCAAGTTAAAATAAGGC fwd_HEK293_4        GGCACTGCGGCTGGAGGTGGGTTTTAGAGCTAGAAATAGCAAGTTAAAATAAGGC fwd_RNF2            GTCATCTTAGTCATTACCTGGTTTTAGAGCTAGAAATAGCAAGTTAAAATAAGGC
```

Sequences of all ssDNA Substrates Used in In Vitro Deaminase Assays.

SEQ ID NOs: 197-199 appear from top to bottom below, respectively.

```
rAPOBEC1            Cy3-ATTATTATTATTCCGCGGATTTATTTATTTATTTA
substrate           TTTATTT hAID/pmCDA1         Cy3-ATTATTATTATTAGCTATTTATTTATTTATTTATT
substrate           TATTT hAPOBEC3G           Cy3-ATTATTATTATTCCCGGATTTATTTATTTATTTAT
substrate           TTATTT
```

Primers Used for Generating PCR Products to Serve as Substrates for T7 Transcription of sgRNAs for Gel-Based Deaminase Assay.

rev_gRNA_T7 was used in all cases. The pFYF1320 plasmid was used as template as noted in Materials and Methods section. SEQ ID NOs: 200-223 appear from top to bottom below, respectively.

```
rev_sgRNA_T7                    AAAAAAAGCACCGACTCGGTG fwd_sgRNA_T7_dsDNA_2            TAATACGACTCACTATAGGCCGCGGATTTATTTATTTAAGTTTTAGAGCTAGAAATAGCA fwd_sgRNA_T7_dsDNA_3            TAATACGACTCACTATAGGTCCGCGGATTTATTTATTTAGTTTTAGAGCTAGAAATAGCA fwd_sgRNA_T7_dsDNA_4            TAATACGACTCACTATAGGTTCCGCGGATTTATTTATTAGTTTTAGAGCTAGAAATAGCA fwd_sgRNA_T7_dsDNA_5            TAATACGACTCACTATAGGATTCCGCGGATTTATTTATTGTTTTAGAGCTAGAAATAGCA fwd_sgRNA_T7_dsDNA_6            TAATACGACTCACTATAGGTATTCCGCGGATTTATTTATGTTTTAGAGCTAGAAATAGCA fwd_sgRNA_T7_dsDNA_7            TAATACGACTCACTATAGGTTATTCCGCGGATTTATTTAGTTTTAGAGCTAGAAATAGCA fwd_sgRNA_T7_dsDNA_8            TAATACGACTCACTATAGGATTATTCCGCGGATTTATTTGTTTTAGAGCTAGAAATAGCA fwd_sgRNA_T7_dsDNA_9            TAATACGACTCACTATAGGTATTATTCCGCGGATTTATTGTTTTAGAGCTAGAAATAGCA fwd_sgRNA_T7_dsDNA_10           TAATACGACTCACTATAGGATTATTATCCGCGGATTTATGTTTTAGAGCTAGAAATAGCA fwd_sgRNA_T7_dsDNA_11           TAATACGACTCACTATAGGTATTATATTCCGCGGATTTAGTTTTAGAGCTAGAAATAGCA twd_sgRNA_T7_dsDNA_12           TAATACGACTCACTATAGGTTATTATATTCCGCGGATTTGTTTTAGAGCTAGAAATAGCA fwd_sgRNA_T7_dsDNA_13           TAATACGACTCACTATAGGATTATTATATTCCGCGGATTGTTTTAGAGCTAGAAATAGCA fwd_sgRNA_T7_dsDNA_14           TAATACGACTCACTATAGGTATTATTATATTCCGCGGATGTTTTAGAGCTAGAAATAGCA fwd_sgRNA_T7_dsDNA_15           TAATACGACTCACTATAGGATTATTATTATTACCGCGGAGTTTTAGAGCTAGAAATAGCA fwd_sgRNA_T7_dsDNA_18           TAATACGACTCACTATAGGATTATTATTATTATTACCGCGTTTTAGAGCTAGAAATAGCA fwd_sgRNA_T7_dsDNA_noC          TAATACGACTCACTATAGGATATTAATTTATTTATTTAAGTTTTAGAGCTAGAAATAGCA fwd_sgRNA_T7_dsDNA_APOE4_C112R  TAATACGACTCACTATAGGGGAGGACGTGCGCGGCCGCCGTTTTAGAGCTAGAAATAGCA fwd_sgRNA_T7_dsDNA_APOE4_C158R  TAATACGACTCACTATAGGGAAGCGCCTGGCAGTGTACCGTTTTAGAGCTAGAAATAGCA fwd_sgRNA_T7_dsDNA_CTNNB1_T41A  TAATACGACTCACTATAGGCTGTGGCAGTGGCACCAGAAGTTTTAGAGCTAGAAATAGCA fwd_sgRNA_T7_dsDNA_HRAS_Q61R    TAATACGACTCACTATAGGCCTCCCGGCCGGCGGTATCCGTTTTAGAGCTAGAAATAGCA fwd_sgRNA_T7_dsDNA_53_Y163C     TAATACGACTCACTATAGGGCTTGCAGATGGCCATGGCGGTTTTAGAGCTAGAAATAGCA
```

| | |
|---|---|
| fwd_sgRNA_T7_dsDNA_53_Y236C | TAATACGACTCACTATAGGACACATGCAGTTGTAGTGGAGTTTTAGAGCTAGAAATAGCA |
| fwd_sgRNA_T7_dsDNA_53_N239D | TAATACGACTCACTATAGGTGTCACACATGTAGTTGTAGGTTTTAGAGCTAGAAATAGCA |

Sequences of 80-Nucleotide Unlabeled Strands and Cy3-Labeled Universal Primer Used in Gel-Based dsDNA Deaminase Assays.

SEQ ID NOs: 224-248 appear from top to bottom below, respectively.

| | |
|---|---|
| Cy3-primer | Cy3-GTAGGTAGTTAGGATGAATGGAAGGTTGGTA |
| dsDNA_2 | GTCCATGGATCCAGAGGTCATCCATTAAATAAATAAATCCGCGGGGCTATACCAACCTTCCATTCATCCTAACTACCTAC |
| dsDNA_3 | GTCCATGGATCCAGAGGTCATCCATAAATAAATAAATCCGCGGAAGCTATACCAACCTTCCATTCATCCTAACTACCTAC |
| dsDNA_4 | GTCCATGGATCCAGAGGTCATCCATAATAAATAAATCCGCGGAAGGCTATACCAACCTTCCATTCATCCTAACTACCTAC |
| dsDNA_5 | GTCCATGGATCCAGAGGTCATCCAAATAAATAAATCCGCGGAATGGCTATACCAACCTTCCATTCATCCTAACTACCTAC |
| dsDNA_6 | GTCCATGGATCCAGAGGTCATCCAATAAATAAATCCGCGGAATAGGCTATACCAACCTTCCATTCATCCTAACTACCTAC |
| dsDNA_7 | GTCCATGGATCCAGAGGTCATCCATAAATAAATCCGCGGAATAAGGCTATACCAACCTTCCATTCATCCTAACTACCTAC |
| dsDNA_8 | GTCCATGGATCCAGAGGTCATCCAAATAAATCCGCGGAATAATGGCTATACCAACCTTCCATTCATCCTAACTACCTAC |
| dsDNA_9 | GTCCATGGATCCAGAGGTCATCCAAATAAATCCGCGGAATAATAGGCTATACCAACCTTCCATTCATCCTAACTACCTAC |
| dsDNA_10 | GTCCATGGATCCAGAGGTCATCCAATAAATCCGCGGATAATAATGGCTATACCAACCTTCCATTCATCCTAACTACCTAC |
| dsDNA_11 | GTCCATGGATCCAGAGGTCATCCATAAATCCGCGGAATATAATAGGCTATACCAACCTTCCATTCATCCTAACTACCTAC |
| dsDNA_12 | GTCCATGGATCCAGAGGTCATCCAAATCCGCGGAATATAATAAGGCTATACCAACCTTCCATTCATCCTAACTACCTAC |
| dsDNA_13 | GTCCATGGATCCAGAGGTCATCCAAATCCGCGGAATATAATAATGGCTATACCAACCTTCCATTCATCCTAACTACCTAC |
| dsDNA_14 | GTCCATGGATCCAGAGGTCATCCAATCCGCGGAATATAATAATAGGCTATACCAACCTTCCATTCATCCTAACTACCTAC |
| dsDNA_15 | GTCCATGGATCCAGAGGTCATCCATCCGCGGTAATAATAATAATGGCTATACCAACCTTCCATTCATCCTAACTACCTAC |
| dsDNA_18 | GTCCATGGATCCAGAGGTCATCCAGCGGTAATAATAATAATAATGGCTATACCAACCTTCCATTCATCCTAACTACCTAC |
| dsDNA_noC | GTCCATGGATCCAGAGGTCATCCATTAAATAAATAAATTAATATTACTATACCAACCTTCCATTCATCCTAACTACCTAC |
| dsDNA_8U | 5Cy3-GTAGGTAGTTAGGATGAATGGAAGGTTGGTGTAGATTATTATCUGCGGATTTATTGGATGACCTCTGGATCCATGGACAT |
| dsDNA_APOE_C112R | GCACCTCGCCGCGGTACTGCACCAGGCGGCCGCGCACGTCCTCCATGTCTACCAACCTTCCATTCATCCTAACTACCTAC |
| dsDNA_APOE_C158R | CGGCGCCCTCGCGGGCCCCGGCCTGGTACACTGCCAGGCGCTTCTGCAGTACCAACCTTCCATTCATCCTAACTACCTAC |
| dsDNA_CTNNB1_T41A | GTCTTACCTGGACTCTGGAATCCATTCTGGTGCCACTGCCACAGCTCCTTACCAACCTTCCATTCATCCTAACTACCTAC |
| dsDNA_HRAS_Q61R | GGAGACGTGCCTGTTGGACATCCTGGATACCGCCGGCCGGGAGGAGTACTACCAACCTTCCATTCATCCTAACTACCTAC |
| dsDNA_p53_Y163C | ACCCCCGCCCGGCACCCGCGTCCGCGCCATGGCCATCTGCAAGCAGTCATACCAACCTTCCATTCATCCTAACTACCTAC |
| dsDNA_p53_Y236C | AGGTTGGCTCTGACTGTACCACCATCCACTACAACTGCATGTGTAACAGTACCAACCTTCCATTCATCCTAACTACCTAC |
| dsDNA_p53_N239D | TGGCTCTGACTGTACCACCATCCACTACAACTACATGTGTGACAGTTCCTACCAACCTTCCATTCATCCTAACTACCTAC |

Primers Used for Generating PCR Products to Serve as Substrates for T7 Transcription of sgRNAs for High-Throughput Sequencing.

rev_gRNA_T7 (above) was used in all cases. The pFYF1320 plasmid was used as template as noted in Materials and Methods section. SEQ ID NOs: 249-300 appear from top to bottom below, respectively.

| | |
|---|---|
| fwd_sgRNA_T7_HTS_base | TAATACGACTCACTATAGGTTATTTCGTGGATTTATTTAGTTTTAGAGCTAGAAATAGCA |
| fwd_sgRNA_T7_HTS_1A | TAATACGACTCACTATAGGATATTTCGTGGATTTATTTAGTTTTAGAGCTAGAAATAGCA |
| fwd_sgRNA_T7_HTS_1C | TAATACGACTCACTATAGGCTATTTCGTGGATTTATTTAGTTTTAGAGCTAGAAATAGCA |
| fwd_sgRNA_T7_HTS_1G | TAATACGACTCACTATAGGGTATTTCGTGGATTTATTTAGTTTTAGAGCTAGAAATAGCA |

-continued

| | |
|---|---|
| Fwd_sgRNA_T7_HTS_2A | TAATACGACTCACTATAGGTAATTTCGTGGATTTATTTAGTTTTAGAGCTAGAAATAGCA |
| fwd_sgRNA_T7_HTS_2C | TAATACGACTCACTATAGGTCATTTCGTGGATTTATTTAGTTTTAGAGCTAGAAATAGCA |
| fwd_sgRNA_T7_HTS_2G | TAATACGACTCACTATAGGTGATTTCGTGGATTTATTTAGTTTTAGAGCTAGAAATAGCA |
| fwd_sgRNA_T7_HTS_3T | TAATACGACTCACTATAGGTTTTTTCGTGGATTTATTTAGTTTTAGAGCTAGAAATAGCA |
| fwd_sgRNA_T7_HTS_3C | TAATACGACTCACTATAGGTTCTTTCGTGGATTTATTTAGTTTTAGAGCTAGAAATAGCA |
| fwd_sgRNA_T7_HTS_3G | TAATACGACTCACTATAGGTTGTTTCGTGGATTTATTTAGTTTTAGAGCTAGAAATAGCA |
| fwd_sgRNA_T7_HTS_4A | TAATACGACTCACTATAGGTTAATTCGTGGATTTATTTAGTTTTAGAGCTAGAAATAGCA |
| fwd_sgRNA_T7_HTS_4C | TAATACGACTCACTATAGGTTACTTCGTGGATTTATTTAGTTTTAGAGCTAGAAATAGCA |
| fwd_sgRNA_T7_HTS_4G | TAATACGACTCACTATAGGTTAGTTCGTGGATTTATTTAGTTTTAGAGCTAGAAATAGCA |
| fwd_sgRNA_T7_HTS_5A | TAATACGACTCACTATAGGTTATATCGTGGATTTATTTAGTTTTAGAGCTAGAAATAGCA |
| fwd_sgRNA_T7_HTS_5C | TAATACGACTCACTATAGGTTATCTCGTGGATTTATTTAGTTTTAGAGCTAGAAATAGCA |
| fwd_sgRNA_T7_HTS_5G | TAATACGACTCACTATAGGTTATGTCGTGGATTTATTTAGTTTTAGAGCTAGAAATAGCA |
| fwd_sgRNA_T7_HTS_6A | TAATACGACTCACTATAGGTTATTACGTGGATTTATTTAGTTTTAGAGCTAGAAATAGCA |
| fwd_sgRNA_T7_HTS_6C | TAATACGACTCACTATAGGTTATTCCGTGGATTTATTTAGTTTTAGAGCTAGAAATAGCA |
| fwd_sgRNA_T7_HTS_6G | TAATACGACTCACTATAGGTTATTGCGTGGATTTATTTAGTTTTAGAGCTAGAAATAGCA |
| fwd_sgRNA_T7_HTS_8A | TAATACGACTCACTATAGGTTATTTCATGGATTTATTTAGTTTTAGAGCTAGAAATAGCA |
| fwd_sgRNA_T7_HTS_8T | TAATACGACTCACTATAGGTTATTTCTTGGATTTATTTAGTTTTAGAGCTAGAAATAGCA |
| fwd_sgRNA_T7_HTS_8C | TAATACGACTCACTATAGGTTATTTCCTGGATTTATTTAGTTTTAGAGCTAGAAATAGCA |
| fwd_sgRNA_T7_HTS_9A | TAATACGACTCACTATAGGTTATTTCGAGGATTTATTTAGTTTTAGAGCTAGAAATAGCA |
| fwd_sgRNA_T7_HTS_9C | TAATACGACTCACTATAGGTTATTTCGCGGATTTATTTAGTTTTAGAGCTAGAAATAGCA |
| fwd_sgRNA_T7_HTS_9G | TAATACGACTCACTATAGGTTATTTCGGGGATTTATTTAGTTTTAGAGCTAGAAATAGCA |
| fwd_sgRNA_T7_HTS_10A | TAATACGACTCACTATAGGTTATTTCGTAGATTTATTTAGTTTTAGAGCTAGAAATAGCA |
| fwd_sgRNA_T7_HTS_10T | TAATACGACTCACTATAGGTTATTTCGTGATTTATTTAGTTTTAGAGCTAGAAATAGCA |
| fwd_sgRNA_T7_HTS_10C | TAATACGACTCACTATAGGTTATTTCGTCGATTTATTTAGTTTTAGAGCTAGAAATAGCA |
| fwd_sgRNA_T7_HTS_11A | TAATACGACTCACTATAGGTTATTTCGTGAATTTATTTAGTTTTAGAGCTAGAAATAGCA |
| fwd_sgRNA_T7_HTS_11T | TAATACGACTCACTATAGGTTATTTCGTGTATTTATTTAGTTTTAGAGCTAGAAATAGCA |
| fwd_sgRNA_T7_HTS_11C | TAATACGACTCACTATAGGTTATTTCGTGCATTTATTTAGTTTTAGAGCTAGAAATAGCA |
| fwd_sgRNA_T7_HTS_12T | TAATACGACTCACTATAGGTTATTTCGTGGTTTATTTAGTTTTAGAGCTAGAAATAGCA |
| fwd_sgRNA_T7_HTS_12C | TAATACGACTCACTATAGGTTATTTCGTGGCTTTATTTAGTTTTAGAGCTAGAAATAGCA |
| fwd_sgRNA_T7_HTS_12G | TAATACGACTCACTATAGGTTATTTCGTGGGTTTATTTAGTTTTAGAGCTAGAAATAGCA |
| fwd_sgRNA_T7_HTS_13A | TAATACGACTCACTATAGGTTATTTCGTGGAATTATTTAGTTTTAGAGCTAGAAATAGCA |
| fwd_sgRNA_T7_HTS_13C | TAATACGACTCACTATAGGTTATTTCGTGGACTTATTTAGTTTTAGAGCTAGAAATAGCA |
| fwd_sgRNA_T7_HTS_13G | TAATACGACTCACTATAGGTTATTTCGTGGAGTTATTTAGTTTTAGAGCTAGAAATAGCA |
| fwd_sgRNA_T7_HTS_muitiC | TAATACGACTCACTATAGGTTCCCCCCCCGATTTATTTAGTTTTAGAGCTAGAAATAGCA |
| fwd_sgRNA_T7_HTS_TCGCACCC_odd | TAATACGACTCACTATAGGCGCACCCGTGGATTTATTTAGTTTTAGAGCTAGAAATAGCA |
| fwd_sgRNA_T7_HTS_CCTCGCAC_odd | TAATACGACTCACTATAGGCTCGCACGTGGATTTATTTAGTTTTAGAGCTAGAAATAGCA |
| fwd_sgRNA_T7_HTS_ACCCTCGC_odd | TAATACGACTCACTATAGGCCCTCGCGTGGATTTATTTAGTTTTAGAGCTAGAAATAGCA |
| fwd_sgRNA_T7_HTS_GCACCCTC_odd | TAATACGACTCACTATAGGCACCCTCGTGGATTTATTTAGTTTTAGAGCTAGAAATAGCA |
| fwd_sgRNA_T7_HTS_TCGCACCC_even | TAATACGACTCACTATAGGTCGCACCCGTGGATTTATTTAGTTTTAGAGCTAGAAATAGCA |
| fwd_sgRNA_T7_HTS_CCTCGCAC_even | TAATACGACTCACTATAGGCCTCGCACGTGGATTTATTTAGTTTTAGAGCTAGAAATAGCA |

-continued

```
fwd_sgRNA_T7_HTS_ACCCTCGC_even  TAATACGACTCACTATAGGACCCTCGCGTGGATTTATTAGTTTTAGAGCTAGAAATAGCA fwd_sgRNA_T7_HTS_GCACCCTC_even  TAATACGACTCACTATAGGGCACCCTCGTGGATTTATTAGTTTTAGAGCTAGAAATAGCA fwd_sgRNA_T7_HTS_EMX1           TAATACGACTCACTATAGGGAGTCCGAGCAGAAGAAGAAGTTTTAGAGCTAGAAATAGCA fwd_sgRNA_T7_HTS_FANCF          TAATACGACTCACTATAGGGGAATCCCTTCTGCAGCACCGTTTTAGAGCTAGAAATAGCA fwd_sgRNA_T7_HTS_HEK293_site2   TAATACGACTCACTATAGGGAACACAAAGCATAGACTGCGTTTTAGAGCTAGAAATAGCA fwd_sgRNA_T7_HTS_HEK293_site3   TAATACGACTCACTATAGGGGCCCAGACTGAGCACGTGAGTTTTAGAGCTAGAAATAGCA fwd_sgRNA_T7_HTS_HEK293_site4   TAATACGACTCACTATAGGGGCACTGCGGCTGGAGGTGGGTTTTAGAGCTAGAAATAGCA fwd_sgRNA_T7_HTS_RNF2           TAATACGACTCACTATAGGGTCATCTTAGTCATTACCTGGTTTTAGAGCTAGAAATAGCA
```

Sequences of In Vitro-Edited dsDNA for High-Throughput Sequencing (HTS).

Shown are the sequences of edited strands. Reverse complements of all sequences shown were also obtained. dsDNA substrates were obtained by annealing complementary strands as described in Materials and Methods. Oligonucleotides representing the EMX1, FANCF, HEK293 site 2, HEK293 site 3, HEK293 site 4, and RNF2 loci were originally designed for use in the gel-based deaminase assay and therefore have the same 25-nt sequence on their 5'-ends (matching that of the Cy3-primer). SEQ ID NOs: 301-352 appear from top to bottom below, respectively.

```
Base sequence  ACGTAAACGGCCACAAGTTCTTATTTCGTGGATTTATTTATGGCATCTTCTTCAAGGACG

1A             ACGTAAACGGCCACAAGTTCATATTTCGTGGATTTATTTATGGCATCTTCTTCAAGGACG

1C             ACGTAAACGGCCACAAGTTCCTATTTCGTGGATTTATTTATGGCATCTTCTTCAAGGACG

1G             ACGTAAACGGCCACAAGTTCGTATTTCGTGGATTTATTTATGGCATCTTCTTCAAGGACG

2A             ACGTAAACGGCCACAAGTTCTAATTTCGTGGATTTATTTATGGCATCTTCTTCAAGGACG

2C             ACGTAAACGGCCACAAGTTCTCATTTCGTGGATTTATTTATGGCATCTTCTTCAAGGACG

2G             ACGTAAACGGCCACAAGTTCTGATTTCGTGGATTTATTTATGGCATCTTCTTCAAGGACG

3T             ACGTAAACGGCCACAAGTTCTTTTTTCGTGGATTTATTTATGGCATCTTCTTCAAGGACG

3C             ACGTAAACGGCCACAAGTTCTTCTTTCGTGGATTTATTTATGGCATCTTCTTCAAGGACG

3G             ACGTAAACGGCCACAAGTTCTTGTTTCGTGGATTTATTTATGGCATCTTCTTCAAGGACG

4A             ACGTAAACGGCCACAAGTTCTTAATTCGTGGATTTATTTATGGCATCTTCTTCAAGGACG

4C             ACGTAAACGGCCACAAGTTCTTACTTCGTGGATTTATTTATGGCATCTTCTTCAAGGACG

4G             ACGTAAACGGCCACAAGTTCTTAGTTCGTGGATTTATTTATGGCATCTTCTTCAAGGACG

5A             ACGTAAACGGCCACAAGTTCTTATATCGTGGATTTATTTATGGCATCTTCTTCAAGGACG

5C             ACGTAAACGGCCACAAGTTCTTATCTCGTGGATTTATTTATGGCATCTTCTTCAAGGACG

5G             ACGTAAACGGCCACAAGTTCTTATGTCGTGGATTTATTTATGGCATCTTCTTCAAGGACG

6A             ACGTAAACGGCCACAAGTTCTTATTACGTGGATTTATTTATGGCATCTTCTTCAAGGACG

6C             ACGTAAACGGCCACAAGTTCTTATTCCGTGGATTTATTTATGGCATCTTCTTCAAGGACG

6G             ACGTAAACGGCCACAAGTTCTTATTGCGTGGATTTATTTATGGCATCTTCTTCAAGGACG

8A             ACGTAAACGGCCACAAGTTCTTATTTCATGGATTTATTTATGGCATCTTCTTCAAGGACG

8T             ACGTAAACGGCCACAAGTTCTTATTTCTTGGATTTATTTATGGCATCTTCTTCAAGGACG

8C             ACGTAAACGGCCACAAGTTCTTATTTCCTGGATTTATTTATGGCATCTTCTTCAAGGACG

9A             ACGTAAACGGCCACAAGTTCTTATTTCGAGGATTTATTTATGGCATCTTCTTCAAGGACG

9C             ACGTAAACGGCCACAAGTTCTTATTTCGCGGATTTATTTATGGCATCTTCTTCAAGGACG

9G             ACGTAAACGGCCACAAGTTCTTATTTCGGGGATTTATTTATGGCATCTTCTTCAAGGACG

10A            ACGTAAACGGCCACAAGTTCTTATTTCGTAGATTTATTTATGGCATCTTCTTCAAGGACG

10T            ACGTAAACGGCCACAAGTTCTTATTTCGTTGATTTATTTATGGCATCTTCTTCAAGGACG
```

| | |
|---|---|
| 10C | ACGTAAACGGCCACAAGTTCTTATTTCGTCGATTTATTTATGGCATCTTCTTCAAGGACG |
| 11A | ACGTAAACGGCCACAAGTTCTTATTTCGTGAATTTATTTATGGCATCTTCTTCAAGGACG |
| 11T | ACGTAAACGGCCACAAGTTCTTATTTCGTGTATTTATTTATGGCATCTTCTTCAAGGACG |
| 11C | ACGTAAACGGCCACAAGTTCTTATTTCGTGCATTTATTTATGGCATCTTCTTCAAGGACG |
| 12T | ACGTAAACGGCCACAAGTTCTTATTTCGTGGTTTTATTTATGGCATCTTCTTCAAGGACG |
| 12C | ACGTAAACGGCCACAAGTTCTTATTTCGTGGCTTTATTTATGGCATCTTCTTCAAGGACG |
| 12G | ACGTAAACGGCCACAAGTTCTTATTTCGTGGGTTTATTTATGGCATCTTCTTCAAGGACG |
| 13A | ACGTAAACGGCCACAAGTTCTTATTTCGTGGAATTATTTATGGCATCTTCTTCAAGGACG |
| 13C | ACGTAAACGGCCACAAGTTCTTATTTCGTGGACTTATTTATGGCATCTTCTTCAAGGACG |
| 13G | ACGTAAACGGCCACAAGTTCTTATTTCGTGGAGTTATTTATGGCATCTTCTTCAAGGACG |
| multiC | ACGTAAACGGCCACAAGTTCTTCCCCCCCCGATTTATTTATGGCATCTTCTTCAAGGACG |
| TCGCACCC_odd | ACGTAAACGGCCACAAGTTTCGCACCCGTGGATTTATTTATGGCATCTTCTTCAAGGACG |
| CCTCGCAC_odd | ACGTAAACGGCCACAAGTTCCTCGCACGTGGATTTATTTATGGCATCTTCTTCAAGGACG |
| ACCCTCGC_odd | ACGTAAACGGCCACAAGTTACCCTCGCGTGGATTTATTTATGGCATCTTCTTCAAGGACG |
| GCACCCTC_odd | ACGTAAACGGCCACAAGTTGCACCCTCGTGGATTTATTTATGGCATCTTCTTCAAGGACG |
| TCGCACCC_even | ACGTAAACGGCCACAAGTATTCGCACCCGTGGATTTATTTATGGCATCTTCTTCAAGGACG |
| CCTCGCAC_even | ACGTAAACGGCCACAAGTATCCTCGCACGTGGATTTATTTATGGCATCTTCTTCAAGGACG |
| ACCCTCGC_even | ACGTAAACGGCCACAAGTATACCCTCGCGTGGATTTATTTATGGCATCTTCTTCAAGGACG |
| GCACCCTC_even | ACGTAAACGGCCACAAGTATGCACCCTCGTGGATTTATTTATGGCATCTTCTTCAAGGACG |
| EMX1_invitro | GTAGGTAGTTAGGATGAATGGAAGGTTGGTAGGCCTGAGTCCGAGCAGAAGAAGAAGGGCTCCCATCACATCAACCGGTG |
| FANCF_invitro | GTAGGTAGTTAGGATGAATGGAAGGTTGGTACTCATGGAATCCCTTCTGCAGCACCTGGATCGCTTTTCCGAGCTTCTGG |
| HEK293_site2_invitro | GTAGGTAGTTAGGATGAATGGAAGGTTGGTAAACTGGAACACAAAGCATAGACTGCGGGGCGGGCCAGCCTGAATAGCTG |
| HEK293_site3_invitro | GTAGGTAGTTAGGATGAATGGAAGGTTGGTACTTGGGGCCCAGACTGAGCACGTGATGGCAGAGGAAAGGAAGCCCTGCT |
| HEK293_site4_invitro | GTAGGTAGTTAGGATGAATGGAAGGTTGGTACCGGTGGCACTGCGGCTGGAGGTGGGGGTTTAAGCGGAGACTCTGGTGC |
| RNF2_invitro | GTAGGTAGTTAGGATGAATGGAAGGTTGGTATGGCAGTCATCTTAGTCATTACCTGAGGTGTTCGTTGTAACTCATATAA |

Primers for HTS of In Vitro Edited dsDNA.

SEQ ID NOs: 353-361 appear from top to bottom below, respectively.

| | |
|---|---|
| fwd_invitro_HTS | ACACTCTTTCCCTACACGACGCTCTTCCGATCTNNNNACGTAAACGGCCACAA |
| rev_invitro_HTS | TGGAGTTCAGACGTGTGCTCTTCCGATCTCGTCCTTGAAGAAGATGC |
| fwd_invitro_HEK_targets | ACACTCTTTCCCTACACGACGCTCTTCCGATCTNNNNGTAGGTAGTTAGGATGAATGGAA |
| rev_EMX1_invitro | TGGAGTTCAGACGTGTGCTCTTCCGATCTCACCGGTTGATGTGATGG |
| rev_FANCF_invitro | TGGAGTTCAGACGTGTGCTCTTCCGATCTCCAGAAGCTCGGAAAAGC |
| rev_HEK293_site2_invitro | TGGAGTTCAGACGTGTGCTCTTCCGATCTCAGCTATTCAGGCTGGC |
| rev_HEK293_site3_invitro | TGGAGTTCAGACGTGTGCTCTTCCGATCTAGCAGGGCTTCCTTTC |
| rev_HEK293_site4_invitro | TGGAGTTCAGACGTGTGCTCTTCCGATCTGCACCAGAGTCTCCG |
| rev_RNF2_invitro | TGGAGTTCAGACGTGTGCTCTTCCGATCTTTATATGAGTTACAACGAACACC |

Primers for HTS of On-Target and Off-Target Sites from all Mammalian Cell Culture Experiments.
SEQ ID NOs: 362-469 appear from top to bottom below, respectively.

| | |
|---|---|
| fwd_EMX1_HTS | ACACTCTTTCCCTACACGACGCTCTTCCGATCTNNNNCAGCTCAGCCTGAGTGTTGA |
| rev_EMX1_HTS | TGGAGTTCAGACGTGTGCTCTTCCGATCTCTCGTGGGTTTGTGGTTGC |
| fwd_FANCF_HTS | ACACTCTTTCCCTACACGACGCTCTTCCGATCTNNNNCATTGCAGAGAGGCGTATCA |
| rev_FANCF_HTS | TGGAGTTCAGACGTGTGCTCTTCCGATCTGGGGTCCCAGGTGCTGAC |
| fwd_HEK293_site2_HTS | ACACTCTTTCCCTACACGACGCTCTTCCGATCTNNNNCCAGCCCCATCTGTCAAACT |
| rev_HEK293_site2_HTS | TGGAGTTCAGACGTGTGCTCTTCCGATCTTGAATGGATTCCTTGGAAACAATGA |
| fwd_HEK293_site3_HTS | ACACTCTTTCCCTACACGACGCTCTTCCGATCTNNNNATGTGGGCTGCCTAGAAAGG |
| rev_HEK293_site3_HTS | TGGAGTTCAGACGTGTGCTCTTCCGATCTCCCAGCCAAACTTGTCAACC |
| fwd_HEK293_site4_HTS | ACACTCTTTCCCTACACGACGCTCTTCCGATCTNNNNGAACCCAGGTAGCCAGAGAC |
| rev_HEK293_site4_HTS | TGGAGTTCAGACGTGTGCTCTTCCGATCTTCCTTTCAACCCGAACGGAG |
| fwd_RNF2_HTS | ACACTCTTTCCCTACACGACGCTCTTCCGATCTNNNNCTCTTCTTTATTTCCAGCAATGT |
| rev_RNF2_HTS | TGGAGTTCAGACGTGTGCTCTTCCGATCTGTTTTCATGTTCTAAAAATGTATCCCA |
| fwd_p53_Y163C_HTS | ACACTCTTTCCCTACACGACGCTCTTCCGATCTNNNNTACAGTACTCCCCTGCCCTC |
| rev_p53_Y163C_HTS | TGGAGTTCAGACGTGTGCTCTTCCGATCTGCTGCTCACCATCGCTATCT |
| fwd_p53_N239D_HTS | ACACTCTTTCCCTACACGACGCTCTTCCGATCTNNNNCCTCATCTTGGGCCTGTGTT |
| rev_p53_N239D_HTS | TGGAGTTCAGACGTGTGCTCTTCCGATCTAAATCGGTAAGAGGTGGGCC |
| fwd_APOE4_C158R_HTS | ACACTCTTTCCCTACACGACGCTCTTCCGATCTNNNNGCGGACATGGAGGACGTG |
| rev_APOE4_C158R_HTS | TGGAGTTCAGACGTGTGCTCTTCCGATCTCTGTTCCACCAGGGGCCC |
| fwd_EMX1_off1_HTS | ACACTCTTTCCCTACACGACGCTCTTCCGATCTNNNNTGCCCAATCATTGATGCTTTT |
| rev_EMX1_off1_HTS | TGGAGTTCAGACGTGTGCTCTTCCGATCTAGAAACATTTACCATAGACTATCACCT |
| fwd_EMX1_off2_HTS | ACACTCTTTCCCTACACGACGCTCTTCCGATCTNNNNAGTAGCCTCTTTCTCAATGTGC |
| rev_EMX1_off2_HTS | TGGAGTTCAGACGTGTGCTCTTCCGATCTGCTTTCACAAGGATGCAGTCT |
| fwd_EMX1_off3_HTS | ACACTCTTTCCCTACACGACGCTCTTCCGATCTNNNNGAGCTAGACTCCGAGGGGA |
| rev_EMX1_off3_HTS | TGGAGTTCAGACGTGTGCTCTTCCGATCTTCCTCGTCCTGCTCTCACTT |
| fwd_EMX1_off4_HTS | ACACTCTTTCCCTACACGACGCTCTTCCGATCTNNNNAGAGGCTGAAGAGGAAGACCA |
| rev_EMX1_off4_HTS | TGGAGTTCAGACGTGTGCTCTTCCGATCTGGCCCAGCTGTGCATTCTAT |
| fwd_EMX1_off6_HTS | ACACTCTTTCCCTACACGACGCTCTTCCGATCTNNNNCCAAGAGGGCCAAGTCCTG |
| rev_EMX1_off6_HTS | TGGAGTTCAGACGTGTGCTCTTCCGATCTCAGCGAGGAGTGACAGCC |
| fwd_EMX1_off7_HTS | ACACTCTTTCCCTACACGACGCTCTTCCGATCTNNNNCACTCCACCTGATCTCGGGG |
| rev_EMX1_off7_HTS | TGGAGTTCAGACGTGTGCTCTTCCGATCTCGAGGAGGGAGGGAGCAG |
| fwd_EMX1_off8_HTS | ACACTCTTTCCCTACACGACGCTCTTCCGATCTNNNNACCACAAATGCCCAAGAGAC |
| rev_EMX1_off8_HTS | TGGAGTTCAGACGTGTGCTCTTCCGATCTGACACAGTCAAGGGCCGG |
| fwd_EMX1_off9_HTS | ACACTCTTTCCCTACACGACGCTCTTCCGATCTNNNNCCCACCTTTGAGGAGGCAAA |
| rev_EMX1_off9_HTS | TGGAGTTCAGACGTGTGCTCTTCCGATCTTTCCATCTGAGAAGAGAGTGGT |
| fwd_EMX1_off10_HTS | ACACTCTTTCCCTACACGACGCTCTTCCGATCTNNNNGTCATACCTTGGCCCTTCCT |
| rev_EMX1_off10_HTS | TGGAGTTCAGACGTGTGCTCTTCCGATCTTCCCTAGGCCCACACCAG |
| fwd_FANCF_off1_HTS | ACACTCTTTCCCTACACGACGCTCTTCCGATCTNNNNAACCCACTGAAGAAGCAGGG |
| rev_FANCF_off1_HTS | TGGAGTTCAGACGTGTGCTCTTCCGATCTGGTGCTTAATCCGGCTCCAT |

-continued

| | |
|---|---|
| fwd_FANCF_off2_HTS | ACACTCTTTCCCTACACGACGCTCTTCCGATCTNNNNTCCAGTGTTTCCATCCCGAA |
| rev_FANCF_off2_HTS | TGGAGTTCAGACGTGTGCTCTTCCGATCTCCTCTGACCTCCACAACTCT |
| fwd_FANCF_off3_HTS | ACACTCTTTCCCTACACGACGCTCTTCCGATCTTTNNNNCTGGGTACAGTTCTGCGTGT |
| rev_FANCF_off3_HTS | TGGAGTTCAGACGTGTGCTCTTCCGATCTTCACTCTGAGCATCGCCAAG |
| fwd_FANCF_off4_HTS | ACACTCTTTCCCTACACGACGCTCTTCCGATCTNNNNGGTTTAGAGCCAGTGAACTAGAG |
| rev_FANCF_off4_HTS | TGGAGTTCAGACGTGTGCTCTTCCGATCTGCAAGACAAAATCCTCTTTATACTTTG |
| fwd_FANCF_off5_HTS | ACACTCTTTCCCTACACGACGCTCTTCCGATCTNNNNGGGAGGGGACGGCCTTAC |
| rev_FANCF_off5_HTS | TGGAGTTCAGACGTGTGCTCTTCCGATCTGCCTCTGGCGAACATGGC |
| fwd_FANCF_off6_HTS | ACACTCTTTCCCTACACGACGCTCTTCCGATCTNNNNTCCTGGTTAAGAGCATGGGC |
| rev_FANCF_off6_HTS | TGGAGTTCAGACGTGTGCTCTTCCGATCTGATTGAGTCCCCACAGCACA |
| fwd_FANCF_off7_HTS | ACACTCTTTCCCTACACGACGCTCTTCCGATCTNNNNCCAGTGTTTCCCATCCCCAA |
| rev_FANCF_off7_HTS | TGGAGTTCAGACGTGTGCTCTTCCGATCTTGACCTCCACAACTGGAAAAT |
| fwd_FANCF_off8_HTS | ACACTCTTTCCCTACACGACGCTCTTCCGATCTNNNNGCTTCCAGACCCACCTGAAG |
| rev_FANCF_off8_HTS | TGGAGTTCAGACGTGTGCTCTTCCGATCTACCGAGGAAAATTGCTTGTCG |
| fwd_HEK293_site2_off1_HTS | ACACTCTTTCCCTACACGACGCTCTTCCGATCTNNNNGTGTGGAGAGTGAGTAAGCCA |
| rev_HEK293_site2_off1_HTS | TGGAGTTCAGACGTGTGCTCTTCCGATCTACGGTAGGATGATTTCAGGCA |
| fwd_HEK293_site2_off2_HTS | ACACTCTTTCCCTACACGACgCTCTTCCGATCTNNNNCACAAAGCAGTGTAGCTCAGG |
| rev_HEK293_site2_off2_HTS | TGGAGTTCAGACGTGTGCTCTTCCGATCTTTTTTGGTACTCGAGTGTTATTCAG |
| fwd_HEK293_site3_off1_HTS | ACACTCTTTCCCTACACGACGCTCTTCCGATCTNNNNTCCCCTGTTGACCTGGAGAA |
| rev_HEK293_site3_off1_HTS | TGGAGTTCAGACGTGTGCTCTTCCGATCTCACTGTACTTGCCCTGACCA |
| fwd_HEK293_site3_off2_HTS | ACACTCTTTCCCTACACGACGCTCTTCCGATCTNNNNTTGGTGTTGACAGGGAGCAA |
| rev_HEK293_site3_off2_HTS | TGGAGTTCAGACGTGTGCTCTTCCGATCTCTGAGATGTGGGCAGAAGGG |
| fwd_HEK293_site3_off3_HTS | ACACTCTTTCCCTACACGACGCTCTTCCGATCTNNNNTGAGAGGGAACAGAAGGGCT |
| rev_HEK293_site3_off3_HTS | TGGAGTTCAGACGTGTGCTCTTCCGATCTGTCCAAAGGCCCAAGAACCT |
| fwd_HEK293_site3_off4_HTS | ACACTCTTTCCCTACACGACGCTCTTCCGATCTNNNNTCCTAGCACTTTGGAAGGTCG |
| rev_HEK293_site3_off4_HTS | TGGAGTTCAGACGTGTGCTCTTCCGATCTGCTCATCTTAATCTGCTCAGCC |
| fwd_HEK293_site3_off5_HTS | ACACTCTTTCCCTACACGACGCTCTTCCGATCTNNNNAAAGGAGCAGCTCTTCCTGG |
| rev_HEK293_site3_off5_HTS | TGGAGTTCAGACGTGTGCTCTTCCGATCTGTCTGCACCATCTCCCACAA |
| fwd_HEK293_site4_off1_HTS | ACACTCTTTCCCTACACGACGCTCTTCCGATCTNNNNGGCATGGCTTCTGAGACTCA |
| rev_HEK293_site4_off1_HTS | TGGAGTTCAGACGTGTGCTCTTCCGATCTGTCTCCCTTGCACTCCCTGTCTTT |
| fwd_HEK293_site4_off2_HTS | ACACTCTTTCCCTACACGACGCTCTTCCGATCTNNNNTTTGGCAATGGAGGCATTGG |
| rev_HEK293_site4_off2_HTS | TGGAGTTCAGACGTGTGCTCTTCCGATCTGAAGAGGCTGCCCATGAGAG |
| fwd_HEK293_site4_off3_HTS | ACACTCTTTCCCTACACGACGCTCTTCCGATCTNNNNGGTCTGAGGCTCGAATCCTG |
| rev_HEK293_site4_off3_HTS | TGGAGTTCAGACGTGTGCTCTTCCGATCTCTGTGGCCTCCATATCCCTG |
| fwd_HEK293_site4_off4_HTS | ACACTCTTTCCCTACACGACGCTCTTCCGATCTNNNNTTTCCACCAGAACTCAGCCC |
| rev_HEK293_site4_off4_HTS | TGGAGTTCAGACGTGTGCTCTTCCGATCTCCTCGGTTCCTCCACAACAC |
| fwd_HEK293_site4_off5_HTS | ACACTCTTTCCCTACACGACGCTCTTCCGATCTNNNNCACGGGAAGGACAGGAGAAC |
| rev_HEK293_site4_off5_HTS | TGGAGTTCAGACGTGTGCTCTTCCGATCTGCAGGGGAGGGATAAAGCAG |
| fwd_HEK293_site4_off6_HTS | ACACTCTTTCCCTACACGACGCTCTTCCGATCTNNNNCCACGGGAGATGGCTTATGT |
| rev_HEK293_site4_off6_HTS | TGGAGTTCAGACGTGTGCTCTTCCGATCTCACATCCTCACTGTGCCACT |

-continued

```
fwd_HEK293_site4_off7_HTS   ACACTCTTTCCCTACACGACGCTCTTCCGATCTNNNNGTCAGTCTCGGCCCCTCA
rev_HEK293_site4_off7_HTS   TGGAGTTCAGACGTGTGCTCTTCCGATCTGCCACTGTAAAGCTCTTGGG
fwd_HEK293_site4_off8_HTS   ACACTCTTTCCCTACACGACGCTCTTCCGATCTNNNNAGGGTAGAGGGACAGAGCTG
rev_HEK293_site4_off8_HTS   TGGgAGTTCAGACGTGTGCTCTTCCGATCTGGACCCCACATAGTCAGTGC
fwd_HEK293_site4_off9_HTS   ACACTCTTTCCCTACACGACGCTCTTCCGATCTNNNNGCTGTCAGCCCTATCTCCATC
rev_HEK293_site4_off9_HTS   TGGAGTTCAGACGTGTGCTCTTCCGATCTTGGGCAATTAGGACAGGGAC
fwd_HEK293_site4_off10_HTS  ACACTCTTTCCCTACACGACGCTCTTCCGATCTNNNNGCAGCGGAGGAGGTAGATTG
rev_HEK293_site4_off10_HTS  TGGAGTTCAGACGTGTGCTCTTCCGATCTCTCAGTACCTGGAGTCCCGA
fwd_HEK2_ChIP_off1_HTS      ACACTCTTTCCCTACACGACGCTCTTCCGATCTNNNNGACAGGCTCAGgAAAGCTGT
rev_HEK2_ChIP_off1_HTS      TGGAGTTCAGACGTGTGCTCTTCCGATCTACACAAGCCTTTCTCCAGGG
fwd_HEK2_ChIP_off2_HTS      ACACTCTTTCCCTACACGACGCTCTTCCGATCTNNNNAATAGGGGGTGAGACTGGGG
rev_HEK2_ChIP_off2_HTS      TGGAGTTCAGACGTGTGCTCTTCCGATCTGCCTCAGACGAGACTTGAGG
fwd_HEK2_ChIP_off3_HTS      ACAGTCTTTCCCTACACGACGCTCTTCCGATCTNNNNGGCCAGCAGGAAAGGAATCT
rev HEK2 ChIP off3 HTS      TGGAGTTCAGACGTGTGCTCTTCCGATCTTGACTGCACCTGTAGCCATG
fwd_HEK2_ChIP_off4_HTS      ACACTCTTTCCCTAGACGACGCTCTTCCGATCTNNNNTCAAGGAAATCACCCTGCCC
rev_HEK2_ChIP_off4_HTS      TGGAGTTCAGACGTGTGCTCTTCCGATCTAACTTCCTTGGTGTGCAGCT
fwd_HEK2_ChIP_off5_HTS      ACACTCTTTCCCTACACGACGCTCTTCCGATCTNNNNATGGGCTCAGCTACGTCATG
rev HEK2 ChIP off5 HTS      TGGAGTTCAGACGTGTGCTCTTCCGATCTAATAGCAGTGTGGTGGGCAA
fwd_HEK3_ChIP_off1_HTS      ACACTCTTTCCCTACACGACGCTCTTCCGATCTNNNNCGCACATCCCTTGTCTCTCT
rev_HEK3_ChIP_off1_HTS      TGGAGTTCAGACGTGTGCTCTTCCGATCTCTACTGGAGCACACCCCAAG
fwd_HEK3_ChIP_off2_HTS      ACACTCTTTCCCTACACGACGCTCTTCCGATCTNNNNTGGGTCACGTAGCTTTGGTC
rev_HEK3_ChIP_off2_HTS      TGGAGTTCAGACGTGTGCTCTTCCGATCTTGGTGGCCATGTGCAACTAA
fwd_HEK3_ChIP_off3_HTS      ACACTCTTTCCCTACACGACGCTCTTCCGATCTNNNNCTACTACGTGCCAGCTCAGG
rev_HEK3_ChIP_off3_HTS      TGGAGTTCAGACGTGTGCTCTTCCGATCTACCTCCCCTCCTCACTAACC
fwd_HEK3_ChIP_off4_HTS      ACACTCTTTCCCTACACGACGCTCTTCCGATCTNNNNGCCTCAGCTCCATTTCCTGT
rev_HEK3_ChIP_off4_HTS      TGAGTTCAGACGTGTGCTCTTCCGATCTAACCTTTATGGCACCAGGGG
fwd_HEK3_ChIP_off5_HTS      ACACTCTTTCCCTACACGACGCTCTTCCGATCTNNNNGAGCTCAGCATTAGCAGGCT
rev_HEK3_ChIP_off5_HTS      TGGAGTTCAGACGTGTGCTCTTCCGATCTTTCCTGGCTTTCCGATTCCC
fwd_HEK4_ChIP_off1_HTS      ACACTCTTTCCCTACACGACGCTCTTCCGATCTNNNNGTGCAATTGGAGGAGGAGCT
rev_HEK4_ChIP_off1_HTS      TGGAGTTCAGACGTGTGCTCTTCCGATCTCACCAGCTACAGGCAGAACA
fwd_HEK4_ChIP_off3_HTS      ACACTCTTTCCCTACACGACGCTCTTCCGATCTNNNNCCTACCCCAACACAGATGG
rev_HEK4_ChIP_off3_HTS      TGGAGTTCAGACGTGTGCTCTTCCGATCTCCACACAACTCAGGTCCTCC
```

Sequences of Single-Stranded Oligonucleotide Donor Templates (ssODNs) Used in HDR Studies.

```
EMX1 sense
                                                            (SEQ ID NO: 470)
TCATCTGTGCCCCTCCCTCCCTGGCCCAGGTGAAGGTGTGGTTCCAGAACCGGAGGACAAAGTACA

AACGGCAGAAGCTGGAGGAGGAAGGGCCTGAGTTTGAGCAGAAGAAGAAGGGCTCCCATCACATC

AACCGGTGGCGCATTGCCACGAAGCAGGCCAATGGGGAGGACATCGATGTCACCTCCAATGACTAG

GGT
```

-continued

EMX1 antisense (SEQ ID NO: 471)
ACCCTAGTCATTGGAGGTGACATCGATGTCCTCCCCATTGGCCTGCTTCGTGGCAATGCGCCACCG

GTTGATGTGATGGGAGCCCTTCTTCTTCTGCTCAAACTGAGGCCCTTCCTCCTCCAGCTTCTGCCGT

TTGTACTTTGTCCTCCGGTTCTGGAACCACACCTTCACCTGGGCCAGGGAGGGAGGGGCACAGATGA

HEK293 site 3 sense (SEQ ID NO: 472)
CATGCAATTAGTCTATTTCTGCTGCAAGTAAGCATGCATTTGTAGGCTTGATGCTTTTTTTCTGCTTCT

CCAGCCCTGGCCTGGGTCAATCCTTGGGGCTTAGACTGAGCACGTGATGGCAGAGGAAAGGAAGC

CCTGCTTCCTCCAGAGGGCGTCGCAGGACAGCTTTTCCTAGACAGGGGCTAGTATGTGCAGCTCCT

HEK293 site 3 antisense (SEQ ID NO: 473)
AGGAGCTGCACATACTAGCCCCTGTCTAGGAAAAGCTGTCCTGCGACGCCCTCTGGAGGAAGCAGG

GCTTCCTTTCCTCTGCCATCACGTGCTCAGTCTAAGCCCCAAGGATTGACCCAGGCCAGGGCTGGA

GAAGCAGAAAAAAAGCATCAAGCCTACAAATGCATGCTTACTTGCAGCAGAAATAGACTAATTGCATG

HEK site 4 sense (SEQ ID NO: 474)
GGCTGACAAAGGCCGGGCTGGGTGGAAGGAAGGGAGGAAGGGCGAGGCAGAGGGTCCAAAGCAG

GATGACAGGCAGGGGCACCGCGGCGCCCCGGTGGCATTGCGGCTGGAGGTGGGGGTTAAAGCGG

AGACTCTGGTGCTGTGTGACTACAGTGGGGGCCCTGCCCTCTCTGAGCCCCGCCTCCAGGCCTGT

GTGTGT

HEK site 4 antisense (SEQ ID NO: 475)
ACACACACAGGCCTGGAGGCGGGGGCTCAGAGAGGGCAGGGCCCCCACTGTAGTCACACAGCACC

AGAGTCTCCGCTTTAACCCCCACCTCCAGCCGCAATGCCACCGGGGCGCCGCGGTGCCCCTGCCT

GTCATCCTGCTTTGGACCCTCTGCCTCGCCCTTCCTCCCTTCCTTCCACCCAGCCCGGCCTTTGTCA

GCC

APOE4 sense (SEQ ID NO: 476)
AGCACCGAGGAGCTGCGGGTGCGCCTCGCCTCCCACCTGCGCAAGCTGCGTAAGCGGCTCCTCCG

CGATGCCGATGACCTGCAGAAGTGCCTGGCAGTGTACCAGGCCGGGGCCCGCGAGGGCGCCGAG

CGCGGCCTCAGCGCCATCCGCGAGCGCCTGGGGCCCCTGGTGGAACAGGGCCGCGTGCGGGCCG

CCACTGT

APOE4 antisense (SEQ ID NO: 477)
ACAGTGGCGGCCCGCACGCGGCCCTGTTCCACCAGGGGCCCCAGGCGCTCGCGGATGGCGCTGA

GGCCGCGCTCGGCGCCCTCGCGGGCCCCGGCCTGGTACACTGCCAGGCACTTCTGCAGGTCATCG

GCATCGCGGAGGAGCCGCTTACGCAGCTTGCGCAGGTGGGAGGCGAGGCGCACCCGCAGCTCCT

CGGTGCT p53 Y163C sense (SEQ ID NO: 478)
ACTCCCCTGCCCTCAACAAGATGTTTTGCCAACTGGCCAAGACCTGCCCTGTGCAGCTGTGGGTTGA

TTCCACACCCCGCCCGGCACCCGCGTCCGCGCCATGGCCATCTACAAGCAGTCACAGCACATGAC

GGAGGTTGTGAGGCGCTGCCCCCACCATGAGCGCTGCTCAGATAGCGATGGTGAGCAGCTGGGGC

TG p53 Y163C antisense (SEQ ID NO: 479)
CAGCCCCAGCTGCTCACCATCGCTATCTGAGCAGCGCTCATGGTGGGGGCAGCGCCTCACAACCTC

CGTCATGTGCTGTGACTGCTTGTAGATGGCCATGGCGCGGACGCGGGTGCCGGGCGGGGGTGTGG

-continued

AATCAACCCACAGCTGCACAGGGCAGGTCTTGGCCAGTTGGCAAAACATCTTGTTGAGGGCAGGGG

AGT

Deaminase Gene gBlocks Gene Fragments hAID
(SEQ ID NO: 169)
rAPOBEC1 (mammalian)
(SEQ ID NO: 170)
CATCCTTGGTACCGAGCTCGGATCCAGCCACCATGAGCTCAGAGACTGGCCCAGTGGCTGTGGACC

CCACATTGAGACGGCGGATCGAGCCCCATGAGTTTGAGGTATTCTTCGATCCGAGAGAGCTCCGCA

AGGAGACCTGCCTGCTTTACGAAATTAATTGGGGGGGCCGGCACTCCATTTGGCGACATACATCACA

GAACACTAACAAGCACGTCGAAGTCAACTTCATCGAGAAGTTCACGACAGAAAGATATTTCTGTCCG

AACACAAGGTGCAGCATTACCTGGTTTCTCAGCTGGAGCCCATGCGGCGAATGTAGTAGGGCCATC

ACTGAATTCCTGTCAAGGTATCCCCACGTCACTCTGTTTATTTACATCGCAAGGCTGTACCACCACGC

TGACCCCCGCAATCGACAAGGCCTGCGGGATTTGATCTCTTCAGGTGTGACTATCCAAATTATGACT

GAGCAGGAGTCAGGATACTGCTGGAGAAACTTGTGAATTATAGCCCGAGTAATGAAGCCCACTGG

CCTAGGTATCCCCATCTGTGGGTACGACTGTACGTTCTTGAACTGTACTGCATCATACTGGGCCTGC

CTCCTTGTCTCAACATTCTGAGAAGGAAGCAGCCACAGCTGACATTCTTTACCATCGCTCTTCAGTCT

TGTCATTACCAGCGACTGCCCCCACACATTCTCTGGGCCACCGGGTTGAAATGAGCGGCCGCTCGA

TTGGTTTGGTGTGGCTCTAA pmCDA1
(SEQ ID NO: 171)
CATCCTTGGTACCGAGCTCGGATCCAGCCACCATGACAGACGCTGAATATGTTAGGATCCATGAAAA

ACTGGATATCTATACATTTAAGAAGCAGTTCTTCAATAACAAAAAGTCAGTATCTCACAGATGCTATGT

CCTGTTCGAACTCAAGAGAAGAGGAGAAAGGCGGGCCTGTTTCTGGGGGTACGCGGTTAATAAACC

CCAGTCCGGGACCGAGAGGGGGATTCACGCCGAGATCTTTTCAATTAGGAAGGTTGAAGAGTATCT

TCGCGACAATCCCGGTCAGTTCACAATTAACTGGTACAGCTCCTGGAGCCCTTGCGCTGATTGCGCC

GAGAAAATACTCGAATGGTACAACCAGGAGTTGAGAGGCAATGGCCACACTCTCAAGATTTGGGCTT

GCAAGCTTTACTACGAGAAGAACGCGAGAAATCAGATTGGCTTGTGGAACCTCAGGGACAACGGGG

TCGGGTTGAATGTTATGGTGTCCGAACATTACCAGTGCTGTAGAAAGATCTTCATTCAGTCCAGTCAC

AATCAGCTGAACGAGAACAGATGGCTGGAGAAAACACTGAAACGGGCAGAGAAAAGGCGCTCAGAG

CTGAGTATCATGATCCAGGTCAAAATCCTGCATACAACCAAAAGCCCGGCTGTATAAGCGGCCGCTC

GATTGGTTTGGTGTGGCTCTAA haPOBEC3G
(SEQ ID NO: 172)
CATCCTTGGTACCGAGCTCGGATCCAGCCACCATGGAGCTGAAGTATCACCCTGAGATGCGGTTTTT

CCACTGGTTTAGTAAGTGGCGCAAACTTCATCGGGATCAGGAGTATGAAGTGACCTGGTATATCTCT

TGGTCTCCCTGCACAAAATGTACACGCGACATGGCCACATTTCTGGCCGAGGATCCAAAGGTGACG

CTCACAATCTTTGTGGCCCGCCTGTATTATTTCTGGGACCCGGATTATCAGGAGGCACTTAGGTCAT

TGTGCCAAAAGCGCGACGGACCACGGGCGACTATGAAAATCATGAATTATGACGAATTCCAGCATTG

CTGGAGTAAGTTTGTGTACAGCCAGCGGGAGCTGTTCGAGCCCTGGAACAATCTTCCCAAGTACTAC

ATACTGCTTCACATTATGTTGGGGGAGATCCTTCGGCACTCTATGGATCCTCCTACCTTTACGTTAA

CTTTAATAATGAGCCTTGGGTTCGCGGGCGCCATGAAACCTATTGTGCTACGAGGTCGAGCGGATG

CATAATGATACGTGGGTCCTGCTGAATCAGAGGAGGGGGTTTCTGTGTAACCAGGCTCCACATAAAC

```
ATGGATTTCTCGAGGGGCGGCACGCCGAACTGTGTTTCCTTGATGTGATACCTTTCTGGAAGCTCGA

CCTTGATCAAGATTACAGGGTGACGTGTTTCACCTCCTGGTCACCCTGCTTCAGTTGCGCCCAAGAG

ATGGCTAAATTTATCAGTAAGAACAAGCATGTGTCCCTCTGTATTTTTACAGCCAGAATTTATGATGAC

CAGGGCCGGTGCCAGGAGGGGCTGCGGACACTCGCTGAGGCGGGCGCGAAGATCAGCATAATGA

CATACTCCGAATTCAAACACTGTTGGGACACTTTTGTGGACCACCAGGGCTGCCCATTTCAGCCGTG

GGATGGGCTCGACGAACATAGTCAGGATCTCTCAGGCCGGCTGCGAGCCATATTGCAGAACCAGGA

GAATTAGGCGGCCGCTCGATTGGTTTGGTGTGGCTCTAA
``` rAPOBEC1 (*E. Coli*)  
(SEQ ID NO: 173)

```
GGCCGGGGATTCTAGAAATAATTTTGTTTAACTTTAAGAAGGAGATATACCATGGATGTCTTCTGAAA

CCCGGTCCGGTTGCGGTTGACCCGACCCTGCGTCGTCGTATCGAACCGCACGAATTCGAAGTTTTCT

TCGACCCGCGTGAACTGCGTAAAGAAACCTGCCTGCTGTACGAAATCAACTGGGGTGGTCGTCACT

CTATCTGGCGTCACACCTCTCAGAACACCAACAAACACGTTGAAGTTAACTTCATCGAAAAATTCACC

ACCGAACGTTACTTCTGCCCGAACACCCGTTGCTCTATCACCTGGTTCCTGTCTTGGTCTCCGTGCG

GTGAATGCTCTCGTGCGATCACCGAATTCCTGTCTCGTTACCCGCACGTTACCCTGTTCATCTACATC

GCGCGTCTGTACCACCACGCGGACCCGCGTAACCGTCAGGGTCTGCGTGACCTGATCTCTTCTGGT

GTTACCATCCAGATCATGACCGAACAGGAATCTGGTTACTGCTGGCGTAACTTCGTTAACTACTCTCC

GTCTAACGAAGCGCACTGGCCGCGTTACCCGCACCTGTGGGTTCGTCTGTACGTTCTGGAACTGTA

CTGCATCATCCTGGGTCTGCCGCCGTGCCTGAACATCCTGCGTCGTAAACAGCCGCAGCTGACCTT

CTTCACCATCGCGCTGCAGTCTTGCCACTACCAGCGTCTGCCGCCGCACATCCTGTGGGCGACCGG

TCTGAAAGGTGGTAGTGGAGGGAGCGGCGGTTCAATGGATAAGAAATAC
```

Amino Acid Sequences of NBE1, NBE2, and NBE3.

NBE1 for *E. Coli* Expression (His$_6$-rAPOBEC1-XTEN-dCas9) (SEQ ID NO: 154)

MGSSHHHHHHMSSETGPVAVDPTLRRRIEPHEFEVFFDPRELRKETCLLY
EINWGGRHSIWRHTSQNTNKHVEVNFIEKFTTERYFCPNTRCSITWFLSW
SPCGECSRAITEFLSRYPHVTLFIYIARLYHHADPRNRQGLRDLISSGVT
IQIMTEQESGYCWRNFVNYSPSNEAHWPRYPHLWVRLYVLELYCIILGLP
PCLNILRRKQPQLTFFTIALQSCHYQRLPPHILWATGLKSGSETPGTSES
ATPESDKKYSIGLAIGTNSVGWAVITDEYKVPSKKFKVLGNTDRHSIKKN
LIGALLFDSGETAEATRLKRTARRRYTRRKNRICYLQEIFSNEMAKVDDS
FFHRLEESFLVEEDKKHERHPIFGNIVDEVAYHEKYPTIYHLRKKLVDST
DKADLRLIYLALAHMIKFRGHFLIEGDLNPDNSDVDKLFIQLVQTYNQLF
EENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKNL
SDAILLSDILRVNTEITKAPLSASMIKRYDEHHQDLTLLKALVRQQLPEK
YKEIFFDQSKNGYAGYIDGGASQEEFYKFIKPILEKMDGTEELLVKLNRE
DLLRKQRTFDNGSIPHQIHLGELHAILRRQEDFYPFLKDNREKIEKILTF
RIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHD

LLKIIKDKDFLDNEENEDILEDIVLTLTLFEDREMIEERLKTYAHLFDDK
VMKQLKRRRYTGWGRLSRKLINGIRDKQSGKTILDFLKSDGFANRNFM
QLIHDDSLTFKEDIQKAQVSGQGDSLHEHIANLAGSPAIKKGILQTVKVV
DELVKVMGRHKPENIVIEMARENQTTQKGQKNSRERMKRIEEGIKELGSQ
ILKEHPVENTQLQNEKLYLYYLQNGRDMYVDQELDINRLSDYDVDAIVPQ
SFLKDDSIDNKVLTRSDKNRGKSDNVPSEEVVKKMKNYWRQLLNAKLITQ
RKFDNLTKAERGGLSELDKAGFIKRQLVETRQITKHVAQILDSRMNTKYD
ENDKLIREVKVITLKSKLVSDFRKDFQFYKVREINNYHHAHDAYLNAVVG
TALIKKYPKLESEFVYGDYKVYDVRKMIAKSEQEIGKATAKYFFYSNIMN
FFKTEITLANGEIRKRPLIETNGETGEIVWDKGRDFATVRKVLSMPQVNI
VKKTEVQTGGFSKESILPKRNSDKLIARKKDWDPKKYGGFDSPTVAYSVL
VVAKVEKGKSKKLKSVKELLGITIMERSSFEKNPIDFLEAKGYKEVKKDL
IIKLPKYSLFELENGRKRMLASAGELQKGNELALPSKYVNFLYLASHYEK
LKGSPEDNEQKQLFVEQHKHYLDEIIEQISEFSKRVILADANLDKVLSAY
NKHRDKPIREQAENIIHLFTLTNLGAPAAFKYFDTTIDRKRYTSTKEVLD
ATLIHQSITGLYETRIDLSQLGGDSGGSPKKKRKV

NBE1 for Mammalian Expression (rAPOBEC1-XTEN-dCas9-NLS) (SEQ ID NO: 155)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDAIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGGSPKKKRKV

Alternative NBE1 for Mammalian Expression with Human APOBEC1 (hAPOBEC1-XTEN-dCas9-NLS) (SEQ ID NO: 158)

MTSEKGPSTGDPTLRRRIEPWEFDVFYDPRELRKEACLLYEIKWGMSRKI
WRSSGKNTTNHVEVNFIKKFTSERDFHPSMSCSITWFLSWSPCWECSQAI
REFLSRHPGVTLVIYVARLFWHMDQQNRQGLRDLVNSGVTIQIMRASEYY
HCWRNFVNYPPGDEAHWPQYPPLWMMLYALELHCIILSLPPCLKISRRWQ
NHLTFFRLHLQNCHYQTIPPHILLATGLIHPSVAWRGSETPGTSESATPE
SDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSPHQIHLGELHAILRRQEDFYPFLKDNREKIEKILTFRIPYYV
GPLARGNSRFAWMTRKSEETITPWNFEEVVDKGASAQSFIERMTNFDKNL
PNEKVLPKHSLLYEYFTVYNELTKVKYVTEGMRKPAFLSGEQKKAIVDLL
FKTNRKVTVKQLKEDYFKKIECFDSVEISGVEDRFNASLGTYHDLLKIIK
DKDFLDNEENEDILEDIVLTLTLFEDREMIEERLKTYAHLFDDKVMKQLK
RRRYTGWGRLSRKLINGIRDKQSGKTILDFLKSDGFANRNFMQLIHDDSL
TFKEDIQKAQVSGQGDSLHEHIANLAGSPAIKKGILQTVKVVDELVKVMG
RHKPENIVIEMARENQTTQKGQKNSRERMKRIEEGIKELGSQILKEHPVE
NTQLQNEKLYLYYLQNGRDMYVDQELDINRLSDYDVDAIVPQSFLKDDSI
DNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIRE
VKVITLKSKLVSDFRKDFQFYKVREINNYHHAHDAYLNAVVGTALIKKYP
KLESEFVYGDYKVYDVRKMIAKSEQEIGKATAKYFFYSNIMNFFKTEITL
ANGEIRKRPLIETNGETGEIVWDKGRDFATVRKVLSMPQVNIVKKTEVQT
GGFSKESILPKRNSDKLIARKKDWDPKKYGGFDSPTVAYSVLVVAKVEKG
KSKKLKSVKELLGITIMERSSFEKNPIDFLEAKGYKEVKKDLIIKLPKYS
LFELENGRKRMLASAGELQKGNELALPSKYVNFLYLASHYEKLKGSPEDN
EQKQLFVEQHKHYLDEIIEQISEFSKRVILADANLDKVLSAYNKHRDKPI
REQAENIIHLFTLTNLGAPAAFKYFDTTIDRKRYTSTKEVLDATLIHQSI
TGLYETRIDLSQLGGDSGGSPKKKRKV

NBE2 (rAPOBEC1-XTEN-dCas9-UGI-NLS) (SEQ ID NO: 156)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESF
LVEEDKKHERHPIFGNIVDEVAYHEKYPTIYHLRKKLVDSTDKADLRLIY

LALAHMIKFRGHFLIEGDLNPDNSDVDKLFIQLVQTYNQLFEENPINASG
VDAKAILSARLSKSRRLENLIAQLPGEKKNGLFGNLIALSLGLTPNFKSN
FDLAEDAKLQLSKDTYDDDLDNLLAQIGDQYADLFLAAKNLSDAILLSDI
LRVNTEITKAPLSASMIKRYDEHHQDLTLLKALVRQQLPEKYKEIFFDQS
KNGYAGYIDGGASQEEFYKFIKPILEKMDGTEELLVKLNREDLLRKQRTF
DNGSIPHQIHLGELHAILRRQEDFYPFLKDNREKIEKILTFRIPYYVGPL
ARGNSRFAWMTRKSEETITPWNFEEVVDKGASAQSFIERMTNFDKNLPNE
KVLPKHSLLYEYFTVYNELTKVKYVTEGMRKPAFLSGEQKKAIVDLLFKT
NRKVTVKQLKEDYFKKIECFDSVEISGVEDRFNASLGTYHDLLKIIKDKD
FLDNEENEDILEDIVLTLTLFEDREMIEERLKTYAHLFDDKVMKQLKRRR
YTGWGRLSRKLINGIRDKQSGKTILDFLKSDGFANRNFMQLIHDDSLTFK
EDIQKAQVSGQGDSLHEHIANLAGSPAIKKGILQTVKVVDELVKVMGRHK
PENIVIEMARENQTTQKGQKNSRERMKRIEEGIKELGSQILKEHPVENTQ
LQNEKLYLYYLQNGRDMYVDQELDINRLSDYDVDAIVPQSFLKDDSIDNK
VLTRSDKNRGKSDNVPSEEVVKKMKNYWRQLLNAKLITQRKFDNLTKAER
GGLSELDKAGFIKRQLVETRQITKHVAQILDSRMNTKYDENDKLIREVKV
ITLKSKLVSDFRKDFQFYKVREINNYHHAHDAYLNAVVGTALIKKYPKLE
SEFVYGDYKVYDVRKMIAKSEQEIGKATAKYFFYSNIMNFFKTEITLANG
EIRKRPLIETNGETGEIVWDKGRDFATVRKVLSMPQVNIVKKTEVQTGGF
SKESILPKRNSDKLIARKKDWDPKKYGGFDSPTVAYSVLVVAKVEKGKSK
KLKSVKELLGITIMERSSFEKNPIDFLEAKGYKEVKKDLIIKLPKYSLFE
LENGRKRMLASAGELQKGNELALPSKYVNFLYLASHYEKLKGSPEDNEQK
QLFVEQHKHYLDEIIEQISEFSKRVILADANLDKVLSAYNKHRDKPIREQ
AENIIHLFTLTNLGAPAAFKYFDTTIDRKRYTSTKEVLDATLIHQSITGL
YETRIDLSQLGGDSGGSTNLSDIIEKETGKQLVIQESILMLPEEVEEVIG
NKPESDILVHTAYDESTDENVMLLTSDAPEYKPWALVIQDSNGENKIKML
SGGSPKKKRKV

NBE3 (rAPOBEC1-XTEN-Cas9n-UGI-NLS) (SEQ ID NO: 157)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV pmCDA1-XTEN-dCas9-UGI (Bacteria) (SEQ ID NO: 159)

MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAVSGSETPGTSESATPESDKKYSIGLAIGTNSVGWAVITDEYKV
PSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVA
YHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIK
PILEKMDGTEELLVKLNREDLLRKQRTFDNGSIPHQIHLGELHAILRRQE
DFYPFLKDNREKIEKILTFRIPYYVGPLARGNSRFAWMTRKSEETITPWN

-continued

FEEVVDKGASAQSFIERMTNFDKNLPNEKVLPKHSLLYEYFTVYNELTKV
KYVTEGMRKPAFLSGEQKKAIVDLLFKTNRKVTVKQLKEDYFKKIECFDS
VEISGVEDRFNASLGTYHDLLKIIKDKDFLDNEENEDILEDIVLTLTLFE
DREMIEERLKTYAHLFDDKVMKQLKRRRYTGWGRLSRKLINGIRDKQSGK
TILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNS
RERMKRIEEGIKELGSQILKEHPVENTQLQNEKLYLYYLQNGRDMYVDQE
LDINRLSDYDVDAIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGDSGGSMTNLS
DIIEKETGKQLVIQESILMLPEEVEEVIGNKPESDILVHTAYDESTDENV
MLLTSDAPEYKPWALVIQDSNGENKIKML pmCDA1-XTEN-nCas9-UGI-NLS (Mammalian Construct) (SEQ ID NO: 160)

MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAVSGSETPGTSESATPESDKKYSIGLAIGTNSVGWAVITDEYKV
PSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVA
YHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIK
PILEKMDGTEELLVKLNREDLLRKQRTFDNGSIPHQIHLGELHAILRRQE
DFYPFLKDNREKIEKILTFRIPYYVGPLARGNSRFAWMTRKSEETITPWN
FEEVVDKGASAQSFIERMTNFDKNLPNEKVLPKHSLLYEYFTVYNELTKV
KYVTEGMRKPAFLSGEQKKAIVDLLFKTNRKVTVKQLKEDYFKKIECFDS
VEISGVEDRFNASLGTYHDLLKIIKDKDFLDNEENEDILEDIVLTLTLFE
DREMIEERLKTYAHLFDDKVMKQLKRRRYTGWGRLSRKLINGIRDKQSGK
TILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNS
RERMKRIEEGIKELGSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGDSGGSTNLSD
IIEKETGKQLVIQESILMLPEEVEEVIGNKPESDILVHTAYDESTDENVM
LLTSDAPEYKPWALVIQDSNGENKIKMLSGGSPKKKRKV huAPOBEC3G-XTEN-dCas9-UGI (Bacteria) (SEQ ID NO: 161)

MDPPTFTFNFNNEPWVRGRHETYLCYEVERMHNDTWVLLNQRRGFLCNQA
PHKHGFLEGRHAELCFLDVIPFWKLDLDQDYRVTCFTSWSPCFSCAQEMA
KFISKNKHVSLCIFTARIYDDQGRCQEGLRTLAEAGAKISIMTYSEFKHC
WDTFVDHQGCPFQPWDGLDEHSQDLSGRLRAILQSGSETPGTSESATPES
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDAIVPQSFLKDDS
IDNKVLTRSDKNRGKSDNVPSEEVVKKMKNYWRQLLNAKLITQRKFDNLT

```
KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGDSGGSMTNLSDIIEKETGKQLVIQESILMLPEEV

EEVIGNKPESDILVHTAYDESTDENVMLLTSDAPEYKPWALVIQDSNGEN

KIKML
``` huAPOBEC3G-XTEN-nCas9-UGI-NLS (Mammalian Construct) (SEQ ID NO: 162)

```
MDPPTFTFNFNNEPWVRGRHETYLCYEVERMHNDTWVLLNQRRGFLCNQA

PHKHGFLEGRHAELCFLDVIPFWKLDLDQDYRVTCFTSWSPCFSCAQEMA

KFISKNKHVSLCIFTARIYDDQGRCQEGLRTLAEAGAKISIMTYSEFKHC

WDTFVDHQGCPFQPWDGLDEHSQDLSGRLRAILQSGSETPGTSESATPES

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGDSGGSTNLSDIIEKETGKQLVIQESILMLPEEVE

EVIGNKPESDILVHTAYDESTDENVMLLTSDAPEYKPWALVIQDSNGENK

IKMLSGGSPKKKRKV
``` huAPOBEC3G (D316R_D317R)-XTEN-nCas9-UGI-NLS (Mammalian Construct) (SEQ ID NO: 163)

```
MDPPTFTFNFNNEPWVRGRHETYLCYEVERMHNDTWVLLNQRRGFLCNQA

PHKHGFLEGRHAELCFLDVIPFWKLDLDQDYRVTCFTSWSPCFSCAQEMA

KFISKNKHVSLCIFTARIYRRQGRCQEGLRTLAEAGAKISIMTYSEFKHC

WDTFVDHQGCPFQPWDGLDEHSQDLSGRLRAILQSGSETPGTSESATPES

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETEIVWDKGRDFATVRKVLSMPQVNIVKKTEVQ

TGGFSKESILPKRNSDKLIARKKDWDPKKYGGFDSPTVAYSVLVVAKVEK
```

-continued

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGDSGGSTNLSDIIEKETGKQLVIQESILMLPEEVE

EVIGNKPESDILVHTAYDESTDENVMLLTSDAPEYKPWALVIQDSNGENK

IKMLSGGSPKKKRKV

Base Calling Matlab Script (SEQ ID NO: 164)

WTnuc = 'GCGGACATGGAGGACGTGCGCGGCCGCCTGGTGCAGTACCG

CGGCGAGGTGCAGGCCATGCTCGGCCAGA

GCACCGAGGAGCTGCGGGTGCGCCTCGCCTCCCACCTGCGCAAGCTGCGT

AAGCGGCTCCTCCGCGATGCCGATGAC

CTGCAGAAGCGCCTGGCAGTGTACCAGGCCGGGGCCCGCGAGGGCGCCGA

GCGCGGCCTCAGCGCCATCCGCGAGCGCCTGGGGCCCCTGGTGGAACAG';

```
%cycle through fastq files for different samples files=dir('*.fastq');
for d=1:20
filename=files(d).name;
%read fastq file
[header,seqs,qscore]=fastqread(filename);
seqsLength = length(seqs);                    % number of sequences seqsFile=
strrep(filename,'.fastq','');                 % trims off .fastq
%create a directory with the same name as fastq file ifexist(seqsFile,'dir');
error('Directory already exists. Please rename or move it before   moving on.');
end
mkdir(seqsFile);                              % make directory
wtLength = length(WTnuc);                     % length of wildtype sequence
%% aligning back to the wildtype nucleotide sequence
%
% AlN is a matrix of the nucleotide alignment window=1:wtLength;
sBLength = length(seqs);                      % number of sequences
% counts number of skips nSkips = 0;
ALN=repmat('',[sBLengthwtLength]);
% iterate through each sequencing read for i = 1:sBLength
%If you only have forward read fastq files leave as is
%If you have R1 foward and R2 is reverse fastq files uncomment the
%next four lines of code and the subsequent end statement
%         ifmod(d,2)==0;
%             reverse=seqrcomplement(seqs{i});
%             [score,alignment,start]=
swalign(reverse,WTnuc,'Alphabet','NT');
%         else
[score,alignment,start]=swalign(seqs{i},WTnuc,'Alphabet','NT');
%         end
% length of the sequencing read len=
length(alignment(3,:));
% if there is a gap in the alignment, skip = 1 and we will
% throw away the entire read skip = 0;
for j = 1:len
if (alignment(3,j) == '-' || alignment(1,j) == '-') skip = 1;
                break;
end
%in addition if the qscore for any given base in the read is
%below 31 the nucleotide is turned into an N (fastq qscores that are not letters)
ifisletter(qscore{i}(start(1)+j-1)) else
alignment(1,j) = 'N';
end
end
if skip == 0 && len>10
ALN(i, start(2):(start(2)+length(alignment)-1))=alignment(1,:);
            end
end
% with the alignment matrices we can simply tally up the occurrences of
% each nucleotide at each column in the alignment these
% tallies ignore bases annotated as N
% due to low qscores
TallyNTD=zeros(5,wtLength); fori=1:wtLength
TallyNTD(:,i)=[sum(ALN(:,i)=='A'),sum(ALN(:,i)=='C'),sum(ALN(:,i)=='G'),sum(ALN
(:,i)=='T'),sum(ALN(:,i)=='N')];
end
% we then save these tally matrices in the respective folder for
% further processing
save(strcat(seqsFile,'/TallyNTD'),'TallyNTD'); dlmwrite(strcat(seqsFile,'/TallyNTD.txt'),TallyNTD,'precision',
'%.3f', 'newline', 'pc'); end
```

INDEL Detection Matlab Script (SEQ ID NO: 164)
WTnuc = 'GCGGACATGGAGGACGTGCGCGGCCGCCTGGTGCAGTACCGC
GGCGAGGTGCAGGCCATGCTCGGCCAGA
GCACCGAGGAGCTGCGGGTGCGCCTCGCCTCCCACCTGCGCAAGCTGCGTA
AGCGGCTCCTCCGCGATGCCGATGAC
CTGCAGAAGCGCCTGGCAGTGTACCAGGCCGGGGCCCGCGAGGGCGCCGAG
CGCGGCCTCAGCGCCATCCGCGAGCGCCTGGGGCCCCTGGTGGAACAG';

```
%cycle through fastq files for different samples files=dir('*.fastq');
%specify start and width of indel window as well as length of each flank indelstart=154;
width=30; flank=10;
for d=1:3
filename=files(d).name;
%read fastq file
[header,seqs,qscore]=fastqread(filename);
seqsLength=length(seqs);              % number of sequences seqsFile
=strcat(strrep(filename,'fastq',''),'_INDELS');
%create a directory with the same name as fastq file+_INDELS ifexist(seqsFile,'dir');
error('Directory already exists. Please rename or move it before moving on.');
end
mkdir(seqsFile);                      % make directory
wtLength = length(WTnuc);             % length of wildtype sequence sBLength =
length(seqs);                         % number of sequences
% initialize counters and cell arrays
nSkips = 0; notINDEL=0;
ins={ };
dels={ }; NumIns=0;
NumDels=0;
% iterate through each sequencing read for i = 1:sBLength
%search for 10BP sequences that should flank both sides of the "INDEL WINDOW"
windowstart=strfind(seqs{i},WTnuc(indelstart-flank:indelstart));
        windowend=strfind(seqs{i},WTnuc(indelstart+width:indelstart+width+flank
));
%if the flanks are found proceed
iflength(windowstart)==1 && length(windowend)==1
%if the sequence length matches the INDEL window length save as
%not INDEL
if windowend-windowstart==width+flank notINDEL=notINDEL+1;
%if the sequence is two or more bases longer than the INDEL
%window length save as an Insertion
elseif windowend-windowstart>=width+flank+2 NumIns=NumIns+1;
ins{NumIns}=seqs{i};
%if the sequence is two or more bases shorter than the INDEL
%window length save as a Deletion
elseif windowend-windowstart<=width+flank-2 NumDels=NumDels+1;
dels{NumDels}=seqs{i};
%keep track of skipped sequences that are either one base
%shorter or longer than the INDEL window width else
nSkips=nSkips+1;
end
%keep track of skipped sequences that do not possess matching flank
%sequences else
nSkips=nSkips+1;
    end
end
fid=fopen(strcat(seqsFile,'/summary.txt'),'wt');
fprintf(fid, 'Skipped reads %i\n not INDEL %i\n Insertions %i\n Deletions
%i\n', [nSkips, notINDEL, NumIns, NumDels]); fclose(fid);
save(strcat(seqsFile,'/nSkips'),'nSkips'); save(strcat(seqsFile,'/notINDEL'),'notINDEL');
save(strcat(seqsFile,'/NumIns'),'NumIns'); save(strcat(seqsFile,'/NumDels'),'NumDels');
save(strcat(seqsFile,'/dels'),'dels');
C = dels;
fid = fopen(strcat(seqsFile, '/dels.txt'), 'wt'); fprintf(fid, '"%s"\n', C{:});
fclose(fid);
save(strcat(seqsFile,'/ins'),'ins'); C = ins;
fid = fopen(strcat(seqsFile, '/ins.txt'), 'wt'); fprintf(fid, '"%s"\n', C{:});
fclose(fid);
end
```

Example 5: Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterisk, of a Cas9 protein may be mutated. In some embodiments, the D10 and/or H840 residues of the amino acid sequence provided in SEQ ID NO: 6, or a corresponding mutation in any Cas9 protein, such as any one of the Cas9 amino acid sequences as provided herein, are mutated. In some embodiments, the D10 residue of the amino acid sequence provided in SEQ ID NO: 6, or a corresponding mutation in any Cas9 protein, such as any one of the Cas9 amino acid sequences as provided herein, is mutated to any amino acid residue, except for D. In some embodiments, the D10 residue of the amino acid sequence provided in SEQ ID NO: 6, or a corresponding mutation in any Cas9 protein, such as any one of the Cas9 amino acid sequences as provided herein, is mutated to an A. In some embodiments, the H840 residue of the amino acid sequence provided in SEQ ID NO: 6, or a corresponding residue in any Cas9 protein, such as any one of the Cas9 amino acid sequences as provided herein, is an H. In some embodiments, the H840 residue of the amino acid sequence provided in SEQ ID NO: 6, or a corresponding mutation in any Cas9 protein, such as any one of the Cas9 amino acid sequences as provided herein, is mutated to any amino acid residue, except for H. In some embodiments, the H840 residue of the amino acid sequence provided in SEQ ID NO: 6, or a corresponding mutation in any Cas9 protein, such as any one of the Cas9 amino acid sequences as provided herein, is mutated to an A. In some embodiments, the D10 residue of the amino acid sequence provided in SEQ ID NO: 6, or a corresponding residue in any Cas9 protein, such as any one of the Cas9 amino acid sequences as provided herein, is a D.

A number of Cas9 sequences from various species were aligned to determine whether corresponding homologous amino acid residues of D10 and H840 of SEQ ID NO: 6 or SEQ ID NO: 567 can be identified in other Cas9 proteins, allowing the generation of Cas9 variants with corresponding mutations of the homologous amino acid residues. The alignment was carried out using the NCBI Constraint-based Multiple Alignment Tool (COBALT(accessible at st-va.ncbi.nlm.nih.gov/tools/cobalt), with the following parameters. Alignment parameters: Gap penalties −11, −1; End-Gap penalties −5, −1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 567|WP_010922251|gi 499224711|type II CRISPR RNA-guided endonuclease Cas9 [*Streptococcus pyogenes*]; Sequence 2 (S2): SEQ ID NO: 568|WP_039695303|gi 746743737|type II CRISPR RNA-guided endonuclease Cas9 [*Streptococcus gallolyticus*]; Sequence 3 (S3): SEQ ID NO: 569|WP_045635197|gi 782887988|type II CRISPR RNA-guided endonuclease Cas9 [*Streptococcus mitis*]; Sequence 4 (S4): SEQ ID NO: 570|5AXW_A|gi 924443546|*Staphylococcus aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1    1 --MDKK-YSIGLD*IGTNSVGWAVITDEYKVPSKKFKVLGNTDRHSIKKNLI--GALLEDSG--ETAEATRLKRTARRRYT   73
S2    1 --MTKKNYSIGLD*IGTNSVGWAVITDDYKVPAKKMKVLGNTDKKYIKKNLI--GALLFDSG--ETAEATRLKRTARRRYT   74
S3    1 --M-KKGYSIGLD*IGTNSVGFAVITDDYKVPSKKMKVLGNTDKRFIKKNLI--GALLFDEG--TTAEARRLKRTARRRYT   73
S4    1 GSHMKRNYILGLD*IGITSVGYGII--DYET----------------RDVIDAGVRLFKEANVENNEGRRSKRGARRLKR   61

S1   74 RRKNRICYLQEIFSNEMAKVDDSFEHRLEESELVEEDKKHERHPIEGNIVDEVAYHEKYPTIYHLRKKLVDSTDKADLRL  153
S2   75 RRKNRLRYLQEIFANETAKVDESFFQRLDESFLTDDDKTEDSHPIEGNKAEEDAYHQKFPTIYHLRKHLADSSEKADLRL  154
S3   74 RRKNRLRYLQEIFSEEMSKVDSSFEHRLDDSFLIPEDKRESKYPIFATLTEEKEYHKQFPTIYHLRKQLADSKEKTDLRL  153
S4   62 RRRHRIQRVKKLL--------------FDYNLLTD-------------------HSELSGINPYEARVKGLSQKLSEEE  107

S1  154 IYLALAHMIKERGHFLIEGDLNPDNSDVDKLFIQLVQTYNQLFEENPINASGVDAKAILSARLSKSRRLENLIAQLPGEK  233
S2  155 VYLALAHMIKFRGHFLIEGELNAENTDVQKIFADFVGVYNRTFDDSHLSEITVDVASILTEKISKSRRLENLIKYYPTEK  234
S3  154 IYLALAHMIKYRGHFLYEEAFDIKNNDIQKIFNEFISIYDNTFEGSSLSGQNAQVEAIFTDKISKSAKRERVLKLEPDEK  233
S4  108 FSAALLHLAKRRG---------------------VHNVNEVEEDT----------------------------------  131

S1  234 KNGLFGNLIALSLGLTPNEKSNFDLAEDAKLQLSKDTYDDDLDNLLAQIGDQYADLFLAAKNLSDAILLSDILRVNTEIT  313
S2  235 KNTLFGNLIALALGLQPNEKTNFKLSEDAKLQFSKDTYEEDLEELLGKIGDDYADLFTSAKNLYDAILLSGILTVDDNST  314
S3  234 STGLFSEFLKLIVGNQADFKKHFDLEDKAPLQFSKDTYDEDLENLLGQIGDDFTDLFVSAKKLYDAILLSGILTVTDPST  313
S4  132 -----GNELS-----------------TKEQISRN---------------------------------------------  144

S1  314 KAPLSASMIKRYDEHHQDLTLLKALVRQQLPEKYKEIFFDQSKNGYAGYIDGGASQEEFYKFIKPILEKM--DGTEELLV  391
S2  315 KAPLSASMIKRYVEHHEDLEKLKEFIKANKSELYHDIFKDKNKNGYAGYIENGVKQDEFYKYLKNILSKIKIDGSDYFLD  394
S3  314 KAPLSASMIERYENHQNDLAALKQFIKNNLPEKYDEVFSDQSKDGYAGYIDGKTTQETFYKYIKNLLSKF--EGTDYFLD  391
S4  145 ----SKALEEKYVAELQ-------------------------------------------LERLKKDG------  165

S1  392 KLNREDLLRKQRTFDNGSIPHQIHLGELHAILRRQEDFYPFLKDNREKIEKILTFRIPYYVGPLARGNSRFAWMTRKSEE  471
S2  395 KIEREDFLRKQRTFDNGSIPHQIHLQEMHAILRRQGDYYPFLKEKQDRIEKILTFRIPYYVGPLVRKDSRFAWAEYRSDE  474
S3  392 KIEREDFLRKQRTFDNGSIPHQIHLQEMNAILRRQGEYYPFLKDNKEKIEKILTFRIPYYVGPLARGNRDFAWLTRNSDE  471
S4  166 --EVRGSINRFKTSD--------YVKEAKQLLKVQKAYHQLDQSFIDTYIDLLETRRTYYEGP--GEGSPFGW------K  227

S1  472 TITPWNFEEVVDKGASAQSFIERMTNFDKNLPNEKVLPKHSLLYEYFTVYNELTKVKYVTEGMRKPAFLSGEQKKAIVDL  551
S2  475 KITPWNFDKVIDKEKSAEKFITRMTLNDLYLPEEKVLPKHSHVYETYAVYNELTKIKYVNEQGKE-SFFDSNMKQEIFDH  553
S3  472 AIRPWNFEEIVDKASSAEDFINKMTNYDLYLPEEKVLPKHSLLYETFAVYNELTKVKFIAEGLRDYQFLDSGQKKQIVNQ  551
S4  228 DIKEW--------------YEMLMGHCTYFPEELRSVKYAYNADLYNALNDLNNLVITRDENEK---LEYYEKFQIIEN  289

S1  552 LEKTNRKVTVKQLKEDYFKKIECFDSVEISGVEDR---FNASLGTYHDLLKIIKDKDFLDNEENEDILEDIVLTLTLFED  628
S2  554 VFKENRKVTKEKLLNYLNKEFPEYRIKDLIGLDKENKSFNASLGTYHDLKKIL-DKAFLDDKVNEEVIEDIIKTLTLFED  632
S3  552 LEKENRKVTEKDIIHYLHN-VDGYDGIELKGIEKQ---FNASLSTYHDLLKIIKDKEEMDDAKNEAILENIVHTLTIFED  627
S4  290 VFKQKKKPTLKQIAKEILVNEEDIKGYRVTSTGKPEF---TNLKVYHDIKDITARKEII---ENAELLDQIAKILTIYQS  363

S1  629 REMIEERLKTYAHLFDDKVMKQLKR-RRYTGWGRLSRKLINGIRDKQSGKTILDFLKSDGFANRNFMQLIHDDSLTFKED  707
S2  633 KDMIHERLQKYSDIFTANQLKKLER-RHYTGWGRLSYKLINGIRNKENNKTILDYLIDDGSANRNFMQLINDDTLPFKQI  711
S3  628 REMIKQRLAQYDSLFDEKVIKALTR-RHYTGWGKLSAKLINGICDKQTGNTILDYLIDDGKINRNFMQLINDDGLSFKEI  706
S4  364 SEDIQEELTNLNSELTQEEIEQISNLKGYTGTHNLSLKAINLILDE------LWHTNDNQIAIFNRLKLVP---------  428
```

```
S1   708  IQKAQVSGQGDSLHEHIANLAGSPAIKKGILQTVKVVDELVKVMGRHKPENIVIEMARENQTT------QKGQKNSRERM   781
S2   712  IQKSQVVGDVDDIEAVVHDLPGSPAIKKGILQSVKIVDELVKVMG-GNPDNIVIEMARENQTT------NRGRSQSQQRL   784
S3   707  IQKAQVIGKTDDVKQVVQELSGSPAIKKGILQSIKIVDELVKVMG-HAPESIVIEMARENQTT------ARGKKNSQQRY   779
S4   429  -KKVDLSQQKEIPTTLVDDFILSPVVKRSFIQSIKVINAIIKKYG--LPNDIIIELAREKNSKDAQKMINEMQKRNRQTN   505

S1   782  KRIEEGIKELGSQIL-------KEHPVENTQLQNEKLYLYYLQNGRDMYVDQELDINRLSD----YDVDH*IVPQSFLKDD   850
S2   785  KKLQNSLKELGSNILNEEKPSYIEDKVENSHLQNDQLFLYYIQNGKDMYTGDELDIDHLSD----YDIDH*IIPQAFIKDD   860
S3   780  KRIEDSLKILASGL---DSNILKENPTDNNQLQNDRLFLYYLQNGKDMYTGEALDINQLSS----YDIDH*IIPQAFIKDD   852
S4   506  ERIEEIIRTTGK---------------ENAKYLIEKIKLHDMQEGKCLYSLEAIPLEDLLNNPFNYEVDH*IIPRSVSFDN   570

S1   851  SIDNKVLTRSDKNRGKSDNVPSEEVVKKMKNYWRQLLNAKLITQRKEDN-LTKAERGGL-SELD------KAGFIKRQLV   922
S2   861  SIDNRVLTSSAKNRGKSDDVPSLDIVRARKAEWVRIYKSGLISKRKFDN-LTKAERGGL-TEAD------KAGFIKRQLV   932
S3   853  SLDNRVLTSSKDNRGKSDNVPSIEVVQKRKAFWQQLLDSKLISERKFNN-LTKAERGGL-DERD------KVGFIKRQLV   924
S4   571  SFNNKVLVKQEEASKKGNRTPFQYLSSSDSKISYETFKKHILNLAKGKGRISKTKKEYLLEERDINRFSVQKDFINRNLV   650

S1   923  ETRQITKHVAQILDSRMNTKYDENDKLIREVKVITLKSKLVSDFRKDFQFYKVREINNYHHAHDAYLNAVVGTALIKKYP  1002
S2   933  ETRQITKHVAQILDARFNTEHDENDKVIRDVKVITLKSNLVSQFRKDFEFYKVREINDYHHAHDAYLNAVVGTALLKKYP  1012
S3   925  ETRQITKHVAQILDARYNTEVNEKDKKNRTVKIITLKSNLVSNFRKEFRLYKVREINDYHHAHDAYLNAVVAKAILKKYP  1004
S4   651  DTRYATRGLMNLLRSYFRVN-------NLDVKVKSINGGFTSFLRRKWKFKKERNKGYKHHAEDALIIA----------   712

S1  1003  KLESEFVYGDYKVYDVRKMIAKSEQ--EIGKATAKYFFYSNIMNFPKTEITLANGEIRKRPLIETNGETGEIVWDKG---  1077
S2  1013  KLASEFVYGEYKKYDIRKFITNSSD-----KATAKYFFYSNLMNFEKTKVKYADGTVFERPIIETNAD-GEIAWNKQ---  1083
S3  1005  KLEPEFVYGEYQKYDLKRYISRSKDPKEVEKATEKYFFYSNLLNFEKEEVHYADGTIVKRENIEYSKDTGEIAWNKE---  1081
S4   713  --NADFIFKEWKKLDKAKKVMENQM------------------------FEEKQAESMPEIETEQEYKEIFITPHQIK    764

S1  1078  -----RDFATVRKVLSMPQVNIVKKTEVQTGGFSKESILPKRNSDKLIARKKD---WDPKKYGGFDSPTVAYSVLVVAKV  1149
S2  1084  -----IDFEKVRKVLSYPQVNIVKKVETQTGGFSKESILPKGDSDKLIPRKTKKVYWDTKKYGGFDSPTVAYSVFVVADV  1158
S3  1082  -----KDFAIIKKVLSLPQVNIVKKREVQTGGFSKESILPKGNSDKLIPRKTKDILLDTTKYGGFDSPVIAYSILLIADI  1156
S4   765  HIKDFKDYKYSHRVDKKPNRELINDTLYSTRKDDKGNTLIVNNLNGLYDKNDKL----KKLIN-KSP----EKLLMYHH   835

S1  1150  EKGKSKKLKSVKELLGITIMERSSFEKNPI-DFLEAKG-----YKEVKKDLIIKLPKYSLFELENGRKRMLASAGELQKG  1223
S2  1159  EKGKAKKLKTVKELVGISIMERSFFEENPV-EFLENKG-----YHNIREDKLIKLPKYSLFEFEGGRRRLLASASELQKG  1232
S3  1157  EKGKAKKLKTVKTLVGITIMEKAAFEENPI-TFLENKG-----YHNVRKENILCLPKYSLFELENGRRRLLASAKELQKG  1230
S4   836  DPQTYQKLK--------LIMEQYGDEKNPLYKYYEETGNYLTKYSKKDNGPVIKKIKYYGNKLNAHLDITDDYPNSRNKV   907

S1  1224  NELALPSKYVNFLYLASHYEKLKGSPEDNEQKQLFVEQHKHYLDEITEQISEFSKRVILADANLDKVLSAYNKH------  1297
S2  1233  NEMVLPGYLVELLYHAHRADNF-----NSTEYLNYVSEHKKEFEKVLSCVEDFANLYVDVEKNLSKIRAVADSM------  1301
S3  1231  NEIVLPVYLTTLLYHSKNVHKL-----DEPGHLEYIQKHRNEFKDLLNLVSEFSQKYVLADANLEKIKSLYADN------  1299
S4   908  VKLSLKPYRFD-VYLDNGVYKFV-----TVKNLDVIK--KENYYEVNSKAYEEAKKLKKISNQAEFIASFYNNDLIKING   979

S1  1298  RDKPIREQAENITHLFTLTNLGAPAAFKYFDTTIDRKRYTSTKEVLDATLIHQSIT--------GLYETRI----DLSQL  1365
S2  1302  DNFSIEEISNSFINLLTLTALGAPADFNFLGEKIPRKRYTSTKECLNATLIHQSIT--------GLYETRI----DLSKL  1369
S3  1300  EQADIEILANSFINLLTFTALGAPAAFKFFGKDIDRKRYTTVSEILNATLIHQSIT--------GLYETWI----DLSKL  1367
S4   980  ELYRVIGVNNDLLNRIEVNMIDITYR-EYLENMNDKRPPRIIKTIASKT---QSIKKYSTDILGNLYEVKSKKHPQIIKK  1055

S1  1366  GGD  1368
S2  1370  GEE  1372
S3  1368  GED  1370
S4  1056  G--  1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 567-570 (e.g., S1, S2, S3, and S4, respectively) are mutated as described herein. The residues D10 and H840 in Cas9 of SEQ ID NO: 6 that correspond to the residues identified in SEQ ID NOs: 567-570 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 6 herein, e.g., mutations of residues 10, and 840 in SEQ ID NO: 6, are referred to herein as "homologous" or "corresponding" mutations. For example, the mutations corresponding to the D10A mutation in SEQ ID NO: 6 or S1 (SEQ ID NO: 567) for the four aligned sequences above are D11A for S2, D10A for S3, and D13A for S4; the corresponding mutations for H840A in SEQ ID NO: 6 or S1 (SEQ ID NO: 567) are H850A for S2, H842A for S3, and H560A for S4.

Example 6: Next Generation C to T Editors

Other families of cytidine deaminases as alternatives to base editor 3 (BE3) constructs were examined. The different C to T editors were developed to have a narrow or different editing window, alternate sequence specificity to expand targetable substrates, and to have higher activity.

Using the methods described in Example 4, the pmCDA1 (cytidine deaminase 1 from Petromyzon marinus) activity at the HeK-3 site is evaluated (FIG. 42). The pmCDA1-nCas9-UGI-NLS (nCas9 indicates the Cas9 nickase described herein) construct is active on some sites (e.g., the C bases on the complementary strand at position 9, 5, 4, and 3) that are not accessible with rAPOBEC1 (BE3).

The pmCDA1 activity at the HeK-2 site is given in FIG. 43. The pmCDA1-XTEN-nCas9-UGI-NLS construct is active on sites adjacent to "G," while rAPOBEC1 analog (BE3 construct) has low activity on "C"s that are adjacent to "G"s, e.g., the C base at position 11 on the complementary strand.

The percent of total sequencing reads with target C converted to T (FIG. 44), C converted to A (FIG. 45), and C converted to G (FIG. 46) are shown for CDA and APOBEC1 (the BE3 construct).

The huAPOBEC3G activity at the HeK-2 site is shown in FIG. 47. Two constructs were used: huAPOBEC3G-XTEN-nCas9-UGI-NLS and huAPOBEC3G*(D316R_D317R)-XTEN-nCas9-UGI-NLS. The huAPOBEC3G-XTEN-nCas9-UGI-NLS construct has different sequence specificity than rAPOBEC1 (BE3), as shown in FIG. 47, the editing window appears narrow, as indicated by APOBEC3G's decreased activity at position 4 compared to APOBEC1. Mutations made in huAPOBEC3G (D316R and D317R) increased ssDNA binding and resulted in an observable effect on expanding the sites which were edited (compare APOBEC3G with APOBEC3G_RR in FIG. 47). Mutations were chosen based on APOBEC3G crystal structure, see: Holden et al., Crystal structure of the anti-viral APOBEC3G catalytic domain and functional implication. Nature. (2008); 121-4, the entire contents of which are incorporated herein by reference.

Example 7: pmCDA1/huAPOBEC3G/rAPOBEC1 Work in E. coli

LacZ selection optimization for the A to I conversion was performed using a bacterial strain with lacZ encoded on the F plasmid. A critical glutamic acid residue was mutated (e.g., GAG to GGG, Glu to Gly mutation) so that G to A by a cytidine deaminase would restore lacZ activity (FIG. 48). Strain CC102 was selected for the selection assay. APOBEC1 and CDA constructs were used in a selection assay to optimize G to A conversion.

To evaluate the effect of copy number of the plasmids encoding the deaminase constructs on lacZ reversion frequency, the CDA and APOBEC1 deaminases were cloned into 4 plasmids with different replication origins (hence different copy numbers), SC101, CloDF3, RSF1030, and PUC (copy number: PUC>RSF1030>CloDF3>SC101) and placed under an inducible promoter. The plasmids were individually transformed into E. coli cells harboring F plasmid containing the mutated LacZ gene. The expression of the deaminases were induced and LacZ activity was detected for each construct (FIG. 49). As shown in FIG. 49, CDA exhibited significantly higher activity than APOBEC1 in all instances, regardless of the plasmid copy number the deaminases were cloned in. Further, In terms of the copy number, the deaminase activity was positively correlated with the copy number of the plasmid they are cloned in, i.e., PUC>CloDF3>SC101.

LacZ reversions were confirmed by sequencing of the genomic DNA at the lacZ locus. To obtain the genomic DNA containing the corrected LacZ gene, cells were grown media containing X-gal, where cells having LacZ activity form blue colonies. Blue colonies were selected and grown in minimal media containing lactose. The cells were spun down, washed, and re-plated on minimal media plates (lactose). The blue colony at the highest dilution was then selected, and its genomic DNA was sequenced at the lacZ locus (FIG. 50).

A chloramphenicol reversion assay was designed to test the activity of different cytidine deaminases (e.g., CDA, and APOBEC1). A plasmid harboring a mutant CAT1 gene which confers chloramphenicol resistance to bacteria is constructed with RSF1030 as the replication origin. The mutant CAT1 gene encodings a CAT1 protein that has a H195R (CAC to CGC) mutation, rendering the protein inactive (FIG. 51). Deamination of the C base-paired to the G base in the CGC codon would convert the codon back to a CAC codon, restoring the activity of the protein. As shown in FIG. 52, CDA outperforms rAPOBEC in E. coli in restoring the activity of the chloramphenicol resistance gene. The minimum inhibitory concentration (MIC) of chlor in S1030 with the selection plasmid (pNMG_ch_5) was approximately 1 µg/mL. Both rAPOBEC-XTEN-dCas9-UGI and CDA-XTEN-dCas9-UGI induced DNA correction on the selection plasmid (FIG. 53).

Next, the huAPOBEC3G-XTEN-dCas9-UGI protein was tested in the same assay. Interestingly, huAPOBEC3G-XTEN-dCas9-UGI exhibited different sequence specificity than the rAPOBEC1-XTEN-dCas9-UGI fusion protein. Only position 8 was edited with APOBEC3G-XTEN-dCas9-UGI fusion, as compared to the rAPOBEC11-XTEN-dCas9-UGIfusion (in which positions 3, 6, and 8 were edited) (FIG. 54).

Example 8: C to T Base Editors with Less Off Target Editing

Current base editing technologies allow for the sequence-specific conversion of a C:G base pair into a T:A base pair in genomic DNA. This is done via the direct catalytic conversion of cytosine to uracil by a cytidine deaminase enzyme and thus, unlike traditional genome editing technologies, does not introduce double-stranded DNA breaks (DSBs) into the DNA as a first step. See, Komor, A. C., Kim, Y. B., Packer, M. S., Zuris, J. A., and Liu, D. R. (2016), "Programmable editing of a target base in genomic DNA without double-stranded DNA cleavage." Nature 533, 420-424; the entire contents of which are incorporated by reference herein. Instead, catalytically dead SpCas9 (dCas9) or a SpCas9 nickase (dCas9(A840H)) is tethered to a cytidine deaminase enzyme such as rAPOBEC1, pmCDA1, or hAPOBEC3G. The genomic locus of interest is encoded by an sgRNA, and DNA binding and local denaturation is facilitated by the dCas9 portion of the fusion. However, just as wt dCas9 and wt Cas9 exhibit off-target DNA binding and cleavage, current base editors also exhibit C to T editing at Cas9 off-target loci, which limits their therapeutic usefulness.

It has been reported that the introduction of just three to four mutations into SpCas9 that neutralize nonspecific electrostatic interactions between the protein and the sugar-phosphate backbone of its target DNA, increases the DNA binding specificity of SpCas9. See, Kleinstiver, B. P., Pattanayak, V., Prew, M. S., Tsai, S. Q., Nguyen, N. T., Zheng, Z., and Joung, J. K. (2016) "High-fidelity CRISPR-Cas9 nucleases with no detectable genome-wide off-target effects." *Nature* 529, 490-495; and Slaymaker, I. M., Gao, L., Zetsche, B., Scott, D. A., Yan, W. X., and Zhang, F. (2015) "Rationally engineered Cas9 nucleases with improved specificity. *Science* 351, 84-88; the entire contents of each are hereby incorporated by reference herein. Four reported neutralizing mutations were therefore incorporated into the initially reported base editor BE3 (SEQ ID NO: 48), and found that off-target C to T editing of this enzyme is also drastically reduced (FIG. 55), with no decrease in on-target editing (FIG. 56).

As shown in FIG. 55, HEK293T cells were transfected with plasmids expressing BE3 or HF-BE3 and a sgRNA matching the EMX1 sequence using LIPOFECTAMINE® 2000 transfection reagent. Three days after transfection, genomic DNA was extracted, amplified by PCR, and analyzed by high-throughput DNA sequencing at the on-target locus, plus the top ten known Cas9 off-target loci for the EMX1 sgRNA, as previously determined by Joung and coworkers using the GUIDE-seq method. See Tsai, S. Q., Zheng, Z., Nguyen, N. T., Liebers, M., Topkar, V. V., Thapar, V., Wyvekens, N., Khayter, C., Iafrate, A. J., Le, L. P., et al. (2015) "GUIDE-seq enables genome-wide profiling of off-target cleavage by CRISPR-Cas nucleases." *Nat Biotech* 33, 187-197; the entire contents of which are incorporated by reference herein. EMX1 off-target 5 locus did not amplify and is not shown. Sequences of the on-target and off-target protospacers and protospacer adjacent motifs (PAMs) are displayed (FIG. 55). Cellular C to T conversion percentages, defined as the percentage of total DNA sequencing reads with T at each position of an original C within the protospacer, are shown for BE3 and HF-BE3.

In FIG. 56, HEK293T cells were transfected with plasmids expressing BE3 or HF-BE3 and sgRNAs matching the genomic loci indicated using LIPOFECTAMINE® 2000 transfection reagent. Three days after transfection, genomic DNA was extracted, amplified by PCR, and analyzed by high-throughput DNA sequencing at the on-target loci. The percentage of total DNA sequencing reads with all four bases at the target Cs within each protospacer are shown for treatment with BE3 or HF-BE3 (FIG. 56). Frequencies of indel formation are shown as well.

Primary Protein Sequence of HF-BE3 (SEQ ID NO: 48):

```
Primary Protein Sequence of HF-BE3:
                                    (SEQ ID NO: 48)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPESDKKYS

IGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYL

ALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTFD

NGSIPHQIHLGELHAILRRQEDFYPFLKDNREKIEKILTFRIPYYVGPLA

RGNSRFAWMTRKSEETITPWNFEEVVDKGASAQSFIERMTAFDKNLPNEK

VLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRY

TGWGALSRKLINGIRDKQSGKTILDFLKSDGFANRNFMALIHDDSLTFKE

DIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERG

GLSELDKAGFIKRQLVETRAITKHVAQILDSRMNTKYDENDKLIREVKVI

TLKSKLVSDFRKDFQFYKVREINNYHHAHDAYLNAVVGTALIKKYPKLES

EFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFS

KESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLY

ETRIDLSQLGGDSGGSTNLSDIIEKETGKQLVIQESILMLPEEVEEVIGN

KPESDILVHTAYDESTDENVMLLTSDAPEYKPWALVIQDSNGENKIKMLS

GGSPKKKRKV
```

Example 9: Development of Base Editors that Use Cas9 Variants and Modulation of the Base Editor Processivity to Increase the Target Range and Precision of the Base Editing Technology Unlike traditional genome editing platforms, base editing technology allows precise single nucleotide changes in the DNA without inducing double-stranded breaks(DSBs). See, Komor, A. C. et al. *Nature* 533, 420-424 (2016). The current generation of base editor uses the NGG PAM exclusively. This limits its ability to edit desired bases within the genome, as the base editor needs to be placed at a precise location where the target base is placed within a 4-base region (the 'deamination window'), approximately 15 bases upstream of the PAM. See, Komor, A. C. et al. *Nature* 533, 420-424 (2016). Moreover, due to the high processivity of cytidine deaminase, the base editor may convert all cytidines within its deamination window into thymidines, which could induce amino acid changes other than the one desired by the researcher. See, Komor, A. C. et al. *Nature* 533, 420-424 (2016).

Expanding the Scope of Base Editing Through the Development of Base Editors with Cas9 Variants Cas9 homologs and other RNA-guided DNA binders that have different PAM specificities were incorporated into the base editor architecture. See, Kleinstiver, B. P. et al. *Nature* 523, 481-485 (2015); Kleinstiver, B. P. et al. *Nature Biotechnology* 33, 1293-1298 (2015); and Zetsche, B. et al. *Cell* 163, 759-771 (2015); the entire contents of each are incorporated by reference herein. Furthermore, innovations that have broadened the PAM specificities of various Cas9 proteins were also incorporated to expand the target reach of the base editor even more. See, Kleinstiver, B. P. et al. *Nature* 523, 481-485 (2015); and Kleinstiver, B. P. et al. *Nature Biotechnology* 33, 1293-1298 (2015). The current palette of base editors is summarized in Table 4.

TABLE 4

New base editors made from Cas9 Variants

| Species | PAM | Base Editor Name | Reference for Cas9 variant |
|---|---|---|---|
| S. pyogenes | . . . NGG | BE3 | Wild-type |
| | . . . NGA | VQR BE3 or EQR BE3 | Kleinstiver, B. P. et al. |
| | . . . NGCG | VRER BE3 | Kleinstiver, B. P. et al. |
| S. aureus | . . . NNGRRT | SaBE3 | Wild-type |
| | . . . NNNRRT | SaKKH BE3 | Kleinstiver, B. P. et al. |
| L. bacterium | TTTN . . . | dCpf1 BE2 | Zetsche, B. et al. |

Modulating Base Editor's Processivity Through Site-Directed Mutagenesis of rAPOBEC1

It was reasoned that the processivity of the base editor could be modulated by making point mutations in the deaminase enzyme. The incorporation of mutations that slightly reduce the catalytic activity of deaminase in which the base editor could still catalyze on average one round of cytidine deamination but was unlikely to access and catalyze another deamination within the relevant timescale were pursued. In effect, the resulting base editor would have a narrower deamination window.

rAPOBEC1 mutations probed in this work are listed in Table 5. Some of the mutations resulted in slight apparent impairment of rAPOBEC1 catalysis, which manifested as preferential editing of one cytidine over another when multiple cytidines are found within the deamination window. Combining some of these mutations had an additive effect, allowing the base editor to discriminate substrate cytidines with higher stringency. Some of the double mutants and the triple mutant allowed selective editing of one cytidine among multiple cytidines that are right next to one another (FIG. 57).

TABLE 5 rAPOBEC1 Point Mutations Investigated

| rAPOBEC1 mutation studied in this work | Corresponding mutation in APOBEC3G | Reference |
|---|---|---|
| H121R/H122R | D315R/D316R | Holden, L. G. et al. |
| R126A | R320A | Chen, K-M. et al. |
| R126E | R320E | Chen, K-M. et al. |
| R118A | R313A | Chen, K-M. et al. |
| W90A | W285A | Chen, K-M. et al. |
| W90Y | W285Y | |
| R132E | R326E | |

Base Editor PAM Expansion and Processivity Modulation

The next generation of base editors were designed to expand editable cytidines in the genome by using other RNA-guided DNA binders (FIG. 58). Using a NGG PAM only allows for a single target within the "window" whereas the use of multiple different PAMs allows for Cas9 to be positioned anywhere to effect selective deamination. A variety of new base editors have been created from Cas9 variants (FIG. 59 and Table 4). Different PAM sites (NGA, FIG. 60; NGCG, FIG. 61; NNGRRT, FIG. 62; and NNHRRT, FIG. 63) were explored. Selective deamination was successfully achieved through kinetic modulation of cytidine deaminase point mutagenesis (FIG. 65 and Table 5).

The effect of various mutations on the deamination window was then investigated in cell culture using spacers with multiple cytidines (FIGS. 66 and 67).

Further, the effect of various mutations on different genomic sites with limited numbers of cytidines was examined (FIGS. 68 to 71). It was found that approximately one cytidine will be edited within the deamination window in the spacer, while the rest of the cytidines will be left intact. Overall, the preference for editing is as follows: $C_6 > C_5 \gg C_7 \approx C_4$.

Base Editing Using Cpf1

Cpf1, a Cas9 homolog, can be obtained as AsCpf1, LbCpf1, or from any other species. Schematics of fusion constructs, including BE2 and BE3 equivalents, are shown in FIG. 73. The BE2 equivalent uses catalytically inactive Cpf2 enzyme (dCpf1) instead of Cas9, while the BE3 equivalent includes the Cpf1 mutant, which nicks the target strand. The bottom schematic depicts different fusion architectures to combine the two innovations illustrated above it (FIG. 73). The base editing results of HEK293T cell TTTN PAM sites using Cpf1 BE2 were examined with different spacers (FIGS. 64A to 64C). In some embodiments, Cpf1 may be used in place of a Cas9 domain in any of the base editors provided herein. In some embodiments, the Cpf1 is a protein that is at least 50%, 55%, 60%, 65%, 70%, 75%, 80%, 85%, 90%, 95%, 98%, 99%, or 99.5% identical to SEQ ID NO 9.

Full Protein Sequence of Cpf1 (SEQ ID NO: 9):

Full Protein Sequence of Cpf1:

(SEQ ID NO: 9)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

```
-continued
GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN
```

Example 10: Increased Fidelity of Base Editing

Examining the difference between plasmid delivery of BE3 and HF-BE3, it was found that the two edit on-target loci with comparable efficiency (FIGS. 74 and 75). However, HF-BE3 edited off-target loci much less than BE3, meaning that HF-BE3 has a much higher DNA specificity than BE3 (FIG. 76). Deaminase protein lipofection to HEK cells demonstrated that protein delivery of BE3 results in comparable on-target activity, but much better specificity, than plasmid DNA delivery of BE3. Using improved transfection procedures and better plasmids (n=2), the experiment used the following conditions: protein delivery was 125 nM Cas9:sgRNA complex, plasmid delivery was 750 ng BE3/HF-BE3 plasmid+250 ng sgRNA plasmid, and lipofection was with 1.5 µL of LIPOFECTAMINE® 2000 transfection reagent per well. EMX-1 off target site 2 and FANCF off-target site 1 showed the most off-target editing with BE3, compared to all of the off-targets assayed (FIGS. 77 and 78), while HEK-3 showed no significant editing at off-targets for any of the delivery methods (FIG. 79). HEK-4 shows some C-to-G editing on at the on-target site, while its off-target sites 1, 3, and 4 showed the most off-target editing of all the assayed sites (FIG. 80).

Delivery of BE3 Protein Via Micro-Injection to Zebrafish

TYR guide RNAs were tested in an in vitro assay for sgRNA activity (FIGS. 81 and 82). The % HTS reads shows how many C residues were converted to T residues during a 2h incubation with purified BE3 protein and PCR of the resulting product. Experiments used an 80-mer synthetic DNA substrate with the target deamination site in 60 bp of its genomic context. This is not the same as % edited DNA strands because only one strand was nicked, so the product is not amplified by PCR. The proportion of HTS reads edited is equal to x/(2-x), where x is the actual proportion of THS reads edited. For 60% editing, the actual proportion of bases edited is 75%. "Off target" is represents BE3 incubated with the same DNA substrate, while bound to an off-target sgRNA. It was found sgRNAs sgRH_13, sgHR_17, and possibly sgHR_16 appeared to be promising targets for in vivo injection experiments.

The delivery of BE3 protein in was tested in vivo in zebrafish. Zebrafish embryos (n=16-24) were injected with either scrambled sgRNA, sgHR_13, sgHR_16, or sgHR_17 and purified BE3. Three embryos from each condition were analyzed independently (single embryo) and for each condition, all of the injected embryos were pooled and sequenced as a pool. The results are shown in FIGS. 83 to 85.

Example 11: Uses of Base Editors to Treat Disease

Base editors or complexes provided herein (e.g., BE3) may be used to modify nucleic acids. For example, base editors may be used to change a cytosine to a thymine in a nucleic acid (e.g., DNA). Such changes may be made to, inter alia, alter the amino acid sequence of a protein, to destroy or create a start codon, to create a stop codon, to disrupt splicing donors, to disrupt splicing acceptors or edit regulatory sequences. Examples of possible nucleotide changes are shown in FIG. 86.

Base editors or complexes provided herein (e.g., BE3) may be used to edit an isoform of Apolipoprotein E in a subject. For example, an Apolipoprotein E isoform may be edited to yield an isoform associated with a lower risk of developing Alzheimer's disease. Apolipoprotein E has four isoforms that differ at amino acids 112 and 158. APOE4 is the largest and most common genetic risk factor for late-onset Alzheimer's disease. Arginine residue 158 of APOE4, encoded by the nucleic acid sequence CGC, may be changed to a cysteine by using a base editor (e.g., BE3) to change the CGC nucleic acid sequence to TGC, which encodes cysteine at residue 158. This change yields an APOE3r isoform, which is associated with lower Alzheimer's disease risk. See FIG. 87.

It was tested whether base editor BE3 could be used to edit APOE4 to APOE3r in mouse astrocytes (FIG. 88). APOE 4 mouse astrocytes were nucleofected with Cas9+ template or BE3, targeting the nucleic acid encoding Arginine 158 of APOE4. The Cas9+ template yielded only 0.3% editing with 26% indels, while BE3 yielded 75% editing with 5% indels. Two additional base-edited cytosines are silent and do not yield changes to the amino acid sequence (FIG. 88).

Base editors or complexes provided herein may be used to treat prion protein diseases such as Creutzfeldt-Jakob disease and fatal familial insomnia, for example, by introducing mutations into a PRNP gene. Reverting PRNP mutations may not yield therapeutic results, and intels in PRNP may be pathogenic. Accordingly, it was tested whether PRNP could be mutated using base editors (e.g., BE3) to introduce a premature stop codon in the PRNP gene. BE3, associated with its guide RNA, was introduced into HEK cells or glioblastoma cells and was capable of editing the PRNP gene to change the encoded arginine at residue 37 to a stop codon. BE3 yielded 41% editing (FIG. 89).

Additional genes that may be edited include the following: APOE editing of Arg 112 and Arg 158 to treat increased Alzheimer's risk; APP editing of Ala 673 to decrease Alzheimer's risk; PRNP editing of Arg 37 to treat fatal familial insomnia and other prion protein diseases; DMD editing of the exons 23 and 51 splice sites to treat Duchenne muscular dystrophy; FTO editing of intron 1 to treat obesity risk; PDS editing of exon 8 to treat Pendred syndrome (genetic deafness); TMC1 editing of exon 8 to treat congenital hearing loss; CYBB editing of various patient-relevant mutations to treat chronic granulomatous disease. Additional diseases that may be treated using the base editors provided herein are shown in Table 6, below.

UGI also plays a key role. Knocking out UDG (which UGI inhibits) was shown to dramatically improve the cleanliness and efficiency of C to T base editing (FIG. 90).

Furthermore, base editors with nickase and without UGI were shown to produce a mixture of outcomes, with very high indel rates (FIG. 91).

Example 12: Expanding the Targeting Scope of Base Editing

Base editing is a new approach to genome editing that uses a fusion protein containing a catalytically defective *Streptococcus pyogenes* Cas9, a cytidine deaminase, and an inhibitor of base excision repair to induce programmable, single-nucleotide C→T (or G→A) changes in DNA without generating double-strand DNA breaks, without requiring a donor DNA template, and without inducing an excess of stochastic insertions and deletions[1]. The development of five new C→T (or G→A) base editors that use natural and engineered Cas9 variants with different protospacer-adjacent motif (PAM) specificities to expand the number of sites that can be targeted by base editing by 2.5-fold are described herein. Additionally, new base editors containing mutated cytidine deaminase domains that narrow the width of the apparent editing window from approximately 5 nucleotides to 1 or 2 nucleotides were engineered, enabling the discrimination of neighboring C nucleotides that would previously be edited with comparable efficiency. Together, these developments substantially increase the targeting scope of base editing.

CRISPR-Cas9 nucleases have been widely used to mediate targeted genome editing[2]. In most genome editing applications, Cas9 forms a complex with a single guide RNA (sgRNA) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR)[3,4]. Unfortunately, under most non-perturbative conditions HDR is inefficient, dependent on cell state and cell type, and dominated by a larger frequency of indels[3,4]. As most of the known genetic variations associated with human disease are point mutations[5], methods that can more efficiently and cleanly make precise point mutations are needed.

Base editing, which enables targeted replacement of a C:G base pair with a T:A base pair in a programmable manner without inducing DSBs[1], has been recently described. Base editing uses a fusion protein between a catalytically inactivated (dCas9) or nickase form of *Streptococcus pyogenes* Cas9 (SpCas9), a cytidine deaminase such as APOBEC1, and an inhibitor of base excision repair such as uracil glycosylase inhibitor (UGI) to convert cytidines into uridines within a five-nucleotide window specified by the sgRNA.[1] The third-generation base editor, BE3, converts C:G base pairs to T:A base pairs, including disease-relevant point mutations, in a variety of cell lines with higher efficiency and lower indel frequency than what can be achieved using other genome editing methods[1]. Subsequent studies have validated the deaminase-dCas9 fusion approach in a variety of settings[6,7].

Efficient editing by BE3 requires the presence of an NGG PAM that places the target C within a five-nucleotide window near the PAM-distal end of the protospacer (positions 4-8, counting the PAM as positions 21-23)[1]. This PAM requirement substantially limits the number of sites in the human genome that can be efficiently targeted by BE3, as many sites of interest lack an NGG 13- to 17-nucleotides downstream of the target C. Moreover, the high activity and processivity of BE3 results in conversion of all Cs within the editing window to Ts, which can potentially introduce undesired changes to the target locus. Herein, new C:G to T:A base editors that address both of these limitations are described.

It was thought that any Cas9 homolog that binds DNA and forms an "R-loop" complex[8] containing a single-stranded DNA bubble could in principle be converted into a base editor. These new base editors would expand the number of targetable loci by allowing non-NGG PAM sites to be edited. The Cas9 homolog from *Staphylococcus aureus* (SaCas9) is considerably smaller than SpCas9 (1053 vs. 1368 residues), can mediate efficient genome editing in mammalian cells, and requires an NNGRRT PAM[9]. SpCas9 was replaced with SaCas9 in BE3 to generate SaBE3 and transfected HEK293T cells with plasmids encoding SaBE3 and sgRNAs targeting six human genomic loci (FIGS. 92A and 92B). After 3 d, the genomic loci were subjected to high-throughput DNA sequencing (HTS) to quantify base editing efficiency. SaBE3 enabled C to T base editing of target Cs at a variety of genomic sites in human cells, with very high conversion efficiencies (approximately 50-75% of total DNA sequences converted from C to T, without enrichment for transfected cells) arising from targeting Cs at positions 6-11. The efficiency of SaBE3 on NNGRRT-containing target sites in general exceeded that of BE3 on NGG-containing target sites[1]. Perhaps due to its higher average efficiency, SaBE3 can also result in detectable base editing at target Cs at positions outside of the canonical BE3 activity window (FIG. 92C). In comparison, BE3 showed significantly reduced editing under the same conditions (0-11%), in accordance with the known SpCas9 PAM preference (FIG. 106A)[10]. These data show that SaBE3 can facilitate very efficient base editing at sites not accessible to BE3.

The targeting range of base editors was further expanded by applying recently engineered Cas9 variants that expand or alter PAM specificities. Joung and coworkers recently reported three SpCas9 mutants that accept NGA (VQR-Cas9), NGAG (EQR-Cas9), or NGCG(VRER-Cas9) PAM sequences[11]. In addition, Joung and coworkers engineered a SaCas9 variant containing three mutations (SaKKH-Cas9) that relax its PAM requirement to NNNRRT[12]. The SpCas9 portion of BE3 was replaced with these four Cas9 variants to produce VQR-BE3, EQR-BE3, VRER-BE3, and SaKKH-BE3, which target NNNRRT, NGA, NGAG, and NGCG PAMs respectively. HEK293T cells were transfected with plasmids encoding these constructs and sgRNAs targeting six genomic loci for each new base editor, and measured C to T base conversions using HTS.

SaKKH-BE3 edited sites with NNNRRT PAMs with efficiencies up to 62% of treated, non-enriched cells (FIG. 92D). As expected, SaBE3 was unable to efficiently edit targets containing PAMs that were NNNHRRT (where H=A, C, or T) (FIG. 92D). VQR-BE3, EQR-BE3, and VRER-BE3 exhibited more modest, but still substantial base editing efficiencies of up to 50% of treated, non-enriched cells at genomic loci with the expected PAM requirements with an editing window similar to that of BE3 (FIGS. 92E and 92F). Base editing efficiencies of VQR-BE3, EQR-BE3, and VRER-BE3 in general closely paralleled the reported PAM requirements of the corresponding Cas9 nucleases; for example, EQR-BE3 was unable to efficiently edit targets containing NGAH PAM sequences (FIG. 92F). In contrast, BE3 was unable to edit sites with NGA or NGCG PAMs efficiently (0-3%), likely due to its PAM restrictions (FIG. 106B).

Collectively, the properties of SaBE3, SaKKH-BE3, VQR-BE3, EQR-BE3, and VRER-BE3 establish that base editors exhibit a modularity that facilitates their ability to exploit Cas9 homologs and engineered variants.

Next, base editors with altered activity window widths were developed. All Cs within the activity window of BE3 can be efficiently converted to Ts[1]. The ability to modulate the width of this window would be useful in cases in which it is important to edit only a subset of Cs present in the BE3 activity window.

The length of the linker between APOBEC1 and dCas9 was previously observed to modulate the number of bases that are accessible by APOBEC1 in vitro[1]. In HEK293T cells, however, varying the linker length did not significantly modulate the width of the editing window, suggesting that in the complex cellular milieu, the relative orientation and flexibility of dCas9 and the cytidine deaminase are not strongly determined by linker length (FIG. 96). Next, it was thought that truncating the 5' end of the sgRNA might narrow the base editing window by reducing the length of single-stranded DNA accessible to the deaminase upon formation of the RNA-DNA heteroduplex. HEK293T cells were co-transfected with plasmids encoding BE3 and sgRNAs of different spacer lengths targeting a locus with multiple Cs in the editing window. No consistent changes in the width of base editing when using truncated sgRNAs with 17- to 19-base spacers were observed (FIGS. 95A to 95C). Truncating the sgRNA spacer to fewer than 17 bases resulted in large losses in activity (FIG. 95A).

As an alternative approach, it was thought that mutations to the deaminase domain might narrow the width of the editing window through multiple possible mechanisms. First, some mutations may alter substrate binding, the conformation of bound DNA, or substrate accessibility to the active site in ways that reduce tolerance for non-optimal presentation of a C to the deaminase active site. Second, because the high activity of APOBEC1 likely contributes to the deamination of multiple Cs per DNA binding event,[1,13,14] mutations that reduce the catalytic efficiency of the deaminase domain of a base editor might prevent it from catalyzing successive rounds of deamination before dissociating from the DNA. Once any C:G to T:A editing event has taken place, the sgRNA no longer perfectly matches the target DNA sequence and re-binding of the base editor to the target locus should be less favorable. Both strategies were tested in an effort to discover new base editors that distinguish among multiple cytidines within the original editing window.

Given the absence of an available APOBEC1 structure, several mutations previously reported to modulate the catalytic activity of APOBEC3G, a cytidine deaminase from the same family that shares 42% sequence similarity of its active site-containing domain to that of APOBEC1, were identified[15]. Corresponding APOBEC1 mutations were incorporated into BE3 and evaluated their effect on base editing efficiency and editing window width in HEK293T cells at two C-rich genomic sites containing Cs at positions 3, 4, 5, 6, 8, 9, 10, 12, 13, and 14 (site A); or containing Cs at positions 5,6, 7, 8, 9, 10, 11, and 13 (site B).

The APOBEC1 mutations R118A and W90A each led to dramatic loss of base editing efficiency (FIG. 97C). R132E led to a general decrease in editing efficiency but did not change the substantially narrow the shape of the editing window (FIG. 97C). In contrast, several mutations that narrowed the width of the editing window while maintaining substantial editing efficiency were found (FIGS. 93A and 97C). The "editing window width" was defined to represent the artificially calculated window width within which editing efficiency exceeds the half-maximal value for that target. The editing window width of BE3 for the two C-rich genomic sites tested was 5.0 (site A) and 6.1 (site B) nucleotides.

R126 in APOBEC1 is predicted to interact with the phosphate backbone of ssDNA[13]. Previous studies have shown that introducing the corresponding mutation into APOBEC3G decreased catalysis by at least 5-fold[14]. Interestingly, when introduced into APOBEC1 in BE3, R126A and R126E increased or maintained activity relative to BE3 at the most strongly edited positions (C5, C6, and C7), while decreasing editing activity at other positions (FIGS. 93A and 97C). Each of these two mutations therefore narrowed the width of the editing window at site A and site B to 4.4 and 3.4 nucleotides (R126A), or to 4.2 and 3.1 nucleotides (R126E), respectively (FIGS. 93A and 97C).

W90 in APOBEC1 (corresponding to W285 in APOBEC3G) is predicted to form a hydrophobic pocket in the APOBEC3G active site and assist in substrate binding[13]. Mutating this residue to Ala abrogated APOBEC3G's catalytic activity[13]. In BE3, W90A almost completely abrogated base editing efficiency (FIG. 97C). In contrast, it was found that W90Y only modestly decreased base editing activity while narrowing the editing window width at site A and site B to 3.8 and 4.9 nucleotides, respectively (FIG. 93A). These results demonstrate that mutations to the cytidine deaminase domain can narrow the activity window width of the corresponding base editors.

W90Y, R126E, and R132E, the three mutations that narrowed the editing window without drastically reducing base editing activity, were combined into doubly and triply mutated base editors. The double mutant W90Y+R126E resulted in a base editor (YE1-BE3) with BE3-like maximal editing efficiencies, but substantially narrowed editing window width (width at site A and site B=2.9 and 3.0 nucleotides, respectively (FIG. 93A). The W90Y+R132E base editor (YE2-BE3) exhibited modestly lower editing efficiencies (averaging 1.4-fold lower maximal editing yields across the five sites tested compared with BE3), and also substantially narrowed editing window width (width at site A and site B=2.7 and 2.8 nucleotides, respectively) (FIG. 97C). The R126E+R132E double mutant (EE-BE3) showed similar maximal editing efficiencies and editing window width as YE2-BE3 (FIG. 97C). The triple mutant W90Y+R126E+R132E (YEE-BE3) exhibited 2.0-fold lower average maximal editing yields but very little editing beyond the C6 position and an editing window width of 2.1 and 1.4 nucleotides for site A and site B, respectively (FIG. 97C). These data taken together indicate that mutations in the cytidine deaminase domain can strongly affect editing window widths, in some cases with minimal or only modest effects on editing efficiency.

The base editing outcomes of BE3, YE1-BE3, YE2-BE3, EE-BE3, and YEE-BE3 were further compared in HEK293T cells targeting four well-studied human genomic sites that contain multiple Cs within the BE3 activity window[1]. These target loci contained target Cs at positions 4 and 5 (HEK site 3), positions 4 and 6 (HEK site 2), positions 5 and 6 (EMX1), or positions 6, 7, 8, and 11 (FANCF). BE3 exhibited little (<1.2-fold) preference for editing any Cs within the position 4-8 activity window. In contrast, YE1-BE3, exhibited a 1.3-fold preference for editing C5 over C4 (HEK site 3), 2.6-fold preference for C6 over C4 (HEK site 2), 2.0-fold preference for C5 over C6 (EMX1), and 1.5-fold preference for C6 over C7 (FANCF) (FIG. 93B). YE2-BE3 and EE-BE3 exhibited somewhat greater positional specificity (narrower activity window) than YE1-BE3, averaging 2.4-fold preference for editing C5 over C4 (HEK site 3), 9.5-fold preference for C6 over C4 (HEK site 2), 2.9-fold preference for C5 over C6 (EMX1), and 2.6-fold preference for C7 over C6 (FANCF) (FIG. 93B). YEE-BE3 showed the greatest positional selectivity, with a 2.9-fold preference for editing C5 over C4 (HEK site 3), 29.7-fold preference for C6 over C4 (HEK site 2), 7.9-fold preference for C5 over C6 (EMX1), and 7.9-fold preference for C7 over C6 (FANCF) (FIG. 93B). The findings establish that mutant base editors can discriminate between adjacent Cs, even when both nucleotides are within the BE3 editing window.

The product distributions of these four mutants and BE3 were further analyzed by HTS to evaluate their apparent processivity. BE3 generated predominantly T4-T5 (HEK site 3), T4-T6 (HEK site 2), and T5-T6 (EMX1) products in treated HEK293T cells, resulting in, on average, 7.4-fold more products containing two Ts, than products containing a single T. In contrast, YE1-BE3, YE2-BE3, EE-BE3, and YEE-BE3 showed substantially higher preferences for singly edited C4-T5, C4-T6, and T5-C6 products (FIG. 93C). YE1-BE3 yielded products with an average single-T to double-T product ratio of 1.4. YE2-BE3 and EE-BE3 yielded products with an average single-T to double-T product ratio of 4.3 and 5.1, respectively (FIG. 93C). Consistent with the above results, the YEE-BE3 triple mutant favored single-T products by an average of 14.3-fold across the three genomic loci. (FIG. 93C). For the target site in which only one C is within the target window (HEK site 4, at position C5), all four mutants exhibited comparable editing efficiencies as BE3 (FIG. 98). These findings indicate that these BE3 mutants have decreased apparent processivity and can favor the conversion of only a single C at target sites containing multiple Cs within the BE3 editing window. These data also suggest a positional preference of C5>C6>C7≈C4 for these mutant base editors, although this preference could differ depending on the target sequence.

The window-modulating mutations in APOBEC1 were applied to VQR-BE3, allowing selective base editing of substrates at sites targeted by NGA PAM (FIG. 107A). However, when these mutations were applied to SaKKH-BE3, a linear decrease in base editing efficiency was observed without the improvement in substrate selectivity, suggesting a different kinetic equilibrium and substrate accessibility of this base editor than those of BE3 and its variants (FIG. 107B).

The five base editors with altered PAM specificities described in this study together increase the number of disease-associated mutations in the ClinVar database that can in principle be corrected by base editing by 2.5-fold (FIGS. 94A and 94B). Similarly, the development of base editors with narrowed editing windows approximately doubles the fraction of ClinVar entries with a properly positioned NGG PAM that can be corrected by base editing without comparable modification of a non-target C (from 31% for BE3 to 59% for YEE-BE3) (FIGS. 94A and 94B).

In summary, the targeting scope of base editing was substantially expanded by developing base editors that use Cas9 variants with different PAM specificities, and by developing a collection of deaminase mutants with varying editing window widths. In theory, base editing should be possible using other programmable DNA-binding proteins (such as Cpf1[16]) that create a bubble of single-stranded DNA that can serve as a substrate for a single-strand-specific nucleotide deaminase enzyme.

Materials and Methods

Cloning. PCR was performed using Q5 Hot Start High-Fidelity DNA Polymerase (New England Biolabs). Plasmids for BE and sgRNA were constructed using USER cloning (New England Biolabs), obtained from previously reported plasmids[1]. DNA vector amplification was carried out using NEB 10beta competent cells (New England Biolabs).

Cell culture. HEK293T (ATCC CRL-3216) were cultured in Dulbecco's Modified Eagle's Medium plus GlutaMax (ThermoFisher) supplemented with 10% (v/v) fetal bovine serum (FBS), at 37° C. with 5% $CO_2$. Immortalized rat astrocytes containing the ApoE4 isoform of the APOE gene (Taconic Biosciences) were maintained in Dulbecco's Modified Eagle's Medium plus GlutaMax (ThermoFisher Scientific) supplemented with 10% (v/v) fetal bovine serum (FBS) and 200 µg/mL Geneticin (ThermoFisher Scientific).

Transfections. HEK293T cells were seeded on 48-well collagen-coated BioCoat plates (Corning) and transfected at approximately 85% confluency. 750 ng of BE and 250 ng of sgRNA expression plasmids were transfected using 1.5 µl of LIPOFECTAMINE® 2000 transfection reagent (ThermoFisher Scientific) per well according to the manufacturer's protocol.

High-throughput DNA sequencing of genomic DNA samples. Transfected cells were harvested after 3 d and the genomic DNA was isolated using the Agencourt DNAdvance Genomic DNA Isolation Kit (Beckman Coulter) according to the manufacturer's instructions. Genomic regions of interest were amplified by PCR with flanking HTS primer pairs listed in the Supplementary Sequences. PCR amplification was carried out with Phusion hot-start II DNA polymerase (ThermoFisher) according to the manufacturer's instructions. PCR products were purified using RapidTips (Diffinity Genomics). Secondary PCR was performed to attach sequencing adaptors. The products were gel-purified and quantified using the KAPA Library Quantification Kit-Illumina (KAPA Biosystems). Samples were sequenced on an Illumina MiSeq as previously described[1].

Data analysis. Nucleotide frequencies were assessed using a previously described MATLAB script[1]. Briefly, the reads were aligned to the reference sequence via the Smith-Waterman algorithm. Base calls with Q-scores below 30 were replaced with a placeholder nucleotide (N). This quality threshold results in nucleotide frequencies with an expected theoretical error rate of 1 in 1000.

Analyses of base editing processivity were performed using a custom python script. This program trims sequencing reads to the 20 nucleotide protospacer sequence as determined by a perfect match for the 7 nucleotide sequences that should flank the target site. These targets were then consolidated and sorted by abundance to assess the frequency of base editing products.

Bioinformatic analysis of the ClinVar database of human disease-associated mutations was performed in a manner similar to that previously described but with small adjustments[1]. These adjustments enable the identification of targets with PAMs of customizable length and sequence. In addition, this improved script includes a priority ranking of target C positions (C5>C6>C7>C8≈C4), thus enabling the identification of target sites in which the on-target C is either the only cytosine within the window or is placed at a position with higher predicted editing efficiency than any off-target C within the editing window.

References for Example 12

1 Komor, A. C. et al. Programmable editing of a target base in genomic DNA without double-stranded DNA cleavage. *Nature* 533, 420-424 (2016).
2 Sander, J. D. & Joung, J. K. CRISPR-Cas systems for editing, regulating and targeting genomes. *Nature biotechnology* 32, 347-355 (2014).
3 Cong, L. et al. Multiplex genome engineering using CRISPR/Cas systems. *Science* 339, 819-823 (2013).
4 Ran, F. A. et al. Genome engineering using the CRISPR-Cas9 system. *Nat. Protocols* 8, 2281-2308 (2013).
Landrum, M. J. et al. ClinVar: public archive of interpretations of clinically relevant variants. *Nucleic Acids Res.* 44, D862-D868 (2015).
6 Nishida, K. et al. Targeted nucleotide editing using hybrid prokaryotic and vertebrate adaptive immune systems. *Science* 353, aaf8729-1-8 (2016).
7 Ma, Y. et al. Targeted AID-mediated mutagenesis (TAM) enables efficient genomic diversification in mammalian cells. *Nat. Methods* doi:10.1038/nmeth.4027 (2016).
8 Jiang, F. et al. Structures of a CRISPR-Cas9 R-loop complex primed for DNA cleavage. *Science* 351, 867-71 (2016).
9 Ran, F. A. et al. In vivo genome editing using *Staphylococcus aureus* Cas9. *Nature* 520, 186-191 (2015).
Zhang, Y. et al. Comparison of non-canonical PAMs for CRISPR/Cas9-mediated DNA cleavage in human cells. *Sci. Rep.* 4, (2014).
11 Kleinstiver, B. P. et. al. Engineered CRISPR-Cas9 nucleases with altered PAM specificities. *Nature* 523, 481-485 (2015).
12 Kleinstiver, B. P. et. al. Broadening the targeting range of *Staphylococcus aureus* CRISPR-Cas9 by modifying PAM recognition. *Nat. Biotechnol.* 33, 1293-1298 (2015).
13 Holden, L. G. et al. Crystal structure of the anti-viral APOBEC3G catalytic domain and functional implications. *Nature* 452, 121-124 (2008).
14 Chen, K.-M. et al. Structure of the DNA deaminase domain of the HIV-1 restriction factor APOBEC3G. *Nature* 452, 116-119 (2008).
Harris, R. S., Petersen-Mahrt, S. K. & Neuberger, M. S. RNA Editing Enzyme APOBEC1 and Some of Its Homologs Can Act as DNA Mutators. *Molecular Cell* 10, 1247-1253 (2002).
16 Zetsche, B. et al. Cpf1 Is a Single RNA-Guided Endonuclease of a Class 2 CRISPR-Cas System. *Cell* 163, 759-771 (2015).

Example 13

Using improved transfection procedures and better plasmids, biological replicates (n=3) were used to install the four HF mutations into the Cas9 portion of BE3. The mutations do not significantly effect on-targeting editing with plasmid delivery (FIG. 99). At the tested concentration, BE3 protein delivery works; however, the on-target editing is lower than for plasmid delivery (FIG. 100). Protein delivery of BE3 with the HF mutations installed reduces on-targeting editing efficiency but still yields some edited cells (FIG. 101).

Both lipofection and installing HF mutations were shown to decrease off-target deamination events. For the four sites shown in FIG. 102, the off-target sites (OT) with the highest GUIDE-Seq reads and deamination events were assayed (Komor et al., Nature, 2016). The specificity ratio was calculated by dividing the off-target editing by the on-target editing at the closest corresponding C. In cases where off-target editing was not detectable, the ratio was set to 100. Thus, a higher specificity ratio indicates a more specific construct. BE3 plasmid delivery showed much higher off-target/on-target editing than protein delivery of BE3, plasmid delivery of HF-BE3, or protein delivery of HF-BE3 (FIGS. 102 and 105).

Purified proteins HF-BE3 and BE3 were analyzed in vitro for their capabilities to convert C to T residues at different positions in the spacer with the most permissive motif. Both BE3 and HF-BE3 proteins were found to have the same "window" for base editing (FIGS. 103 and 104).

A list of the disease targets is given in Table 8. The base to be edited in Table 8 is indicated in bold and underlined.

TABLE 8

Base Editor Disease Targets

| GENE | DISEASE | SPACER | SEQ ID NO | PAM | EDITOR | DEFECT | CELL |
|---|---|---|---|---|---|---|---|
| RB1 | RETINOBLASTOMA | AATCTAGTAAATAA ATTGATGT | 571 | AAAA GT | SAKKH-BE3 | SPLICING IMPAIRMENT | J82 |
| PTEN | CANCER | GACCAACGGCTAAG TGAAGA | 572 | TGA | VQR-BE3 | W111R | MC116 |
| PIK3CA | CANCER | TCCTTTCTTCACGGT TGCCT | 573 | ACTG GT | SAKKH-BE3 | K111R | CRL-5853 |
| PIK3CA | CANCER | CTCCTGCTCAGTGAT TTCAG | 574 | AGA | VQR-BE3 | Q546R | CRL-2505 |
| TP53 | CANCER | TGTCACACATGTAGT TGTAG | 575 | TGG | YEE-BE3 | N239D | SNU475 |
| HRAS | CANCER | CCTCCCGGCCGGCGG TATCC | 576 | AGG | YEE-BE3 | Q61R | MC/CAR |

TABLE 6

Exemplary diseases that may be treated using base editors. The protospacer and PAM sequences (SEQ ID NOS: 577-589) are shown in the sgRNA (PAM) column. The PAM sequence is shown in parentheses and with the base to be edited indicated by underlining.

| Disease target | gene symbol | Base changed | sgRNA (PAM) | Base editor |
|---|---|---|---|---|
| Prion disease | PRNP | R37* | GGCAGCCGATACCCGGGGCA(GGG)<br>GGGCAGCCGATACCCGGGGC(AGG) | BE3 |
| Pendred syndrome | Slc26a4 | c.919-2A > G | TTATTGTCCGAAATAAAAGA(AGA)<br>ATTGTCCGAAATAAAAGAAG(AGG)<br>TTGTCCGAAATAAAAGAAGA(GGA)<br>GTCCGAAATAAAAGAAGAGGAAAA(AAT)<br>GTCCGAAATAAAAGAAGAGGAAAAA(ATT) | BE3<br>(VQR<br>SaCas9) |
| Congenital deafness | Tmc1 | c.545A > G | CAGGAAGCACGAGGCCACTG(AGG)<br>AACAGGAAGCACGAGGCCAC(TGA)<br>AGGAAGCACGAGGCCACTGA(GGA) | BE3<br>YE-BE3<br>YEE-BE3 |
| Acquired deafness | SNHL | S33F | TTGGATTCTGGAATCCATTC(TGG) | BE3 |
| Alzheimer's Disease | APP | A673T | TCTGCATCCATCTTCACTTC(AGA) | BE3 VQR |
| Niemann-Pick Disease Type C | NPC1 | I1061T | CTTACAGCCAGTAATGTCAC(CGA) | BE3 VQR |

Example 14: Testing Base Editing Constructs

Several base editing constructs, including BE3, BE4-pmCDA1, BE4-hAID, BE4-3G, BE4-N, BE4-SSB, BE4-(GGS)₃, BE4-XTEN, BE4-32aa, BE4-2×UGI, and BE4 were tested for their ability to edit a cytosine (C) residue within different target sequences (i.e., EMX1, FANCF, HEK2, HEK3, HEK4, and RNF2). For example, it was tested whether these constructs were capable of producing a C to T mutation. Schematic representations of the base editing constructs are shown in FIG. 109. The target sequences tested are also shown in FIG. 109 with the targeted cytosine numbered and indicated in red.

The following amino acid sequences were used in the base editing constructs of this example:

UGI:

(SEQ ID NO: 736)
TNLSDIIEKETGKQLVIQESILMLPEEVEEVIGNKPESDILVHTAYDEST
DENVMLLTSDAPEYKPWALVIQDSNGENKIKML rAPOBEC1:

(SEQ ID NO: 737)
SSETGPVAVDPTLRRRIEPHEFEVFFDPRELRKETCLLYEINWGGRHSIW
RHTSQNTNKHVEVNFIEKFTTERYFCPNTRCSITWFLSWSPCGECSRAIT
EFLSRYPHVTLFIYIARLYHHADPRNRQGLRDLISSGVTIQIMTEQESGY
CWRNFVNYSPSNEAHWPRYPHLWVRLYVLELYCIILGLPPCLNILRRKQP
QLTFFTIALQSCHYQRLPPHILWATGLK pmCDA1:

(SEQ ID NO: 81)
MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAV hAID:

(SEQ ID NO: 49)
MDSLLMNRRKFLYQFKNVRWAKGRRETYLCYVVKRRDSATSFSLDFGYLR
NKNGCHVELLFLRYISDWDLDPGRCYRVTWFTSWSPCYDCARHVADFLRG
NPNLSLRIFTARLYFCEDRKAEPEGLRRLHRAGVQIAIMTFKDYFYCWNT
FVENHERTFKAWEGLHENSVRLSRQLRRILLPLYEVDDLRDAFRTLGL hAPOBEC3G:

(SEQ ID NO: 60)
MELKYHPEMRFFHWFSKWRKLHRDQEYEVTWYISWSPCTKCTRDMATFLA
EDPKVTLTIFVARLYYFWDPDYQEALRSLCQKRDGPRATMKIMNYDEFQH
CWSKFVYSQRELFEPWNNLPKYYILLHIMLGEILRHSMDPPTFTFNFNNE
PWVRGRHETYLCYEVERMHNDTWVLLNQRRGFLCNQAPHKHGFLEGRHAE
LCFLDVIPFWKLDLDQDYRVTCFTSWSPCFSCAQEMAKFISKNKHVSLCI
FTARIYDDQGRCQEGLRTLAEAGAKISIMTYSEFKHCWDTFVDHQGCPFQ
PWDGLDEHSQDLSGRLRAILQNQEN

SSB (Single-Stranded DNA Binding Protein):

(SEQ ID NO: 590)
ASRGVNKVILVGNLGQDPEVRYMPNGGAVANITLATSESWRDKATGEMKE
QTEWHRVVLFGKLAEVASEYLRKGSQVYIEGQLRTRKWTDQSGQDRYTTE
VVVNVGGTMQMLGGRQGGGAPAGGNIGGGQPQGGWGQPQQPQGGNQFSGG
AQSRPQQSAPAAPSNEPPMDFDDDIPF

Linker Sequences:
XTEN:

```
                                        (SEQ ID NO: 604)
            SGSETPGTSESATPES
```

32aa:

```
                                        (SEQ ID NO: 605)
      SGGSSGGSSGSETPGTSESATPESSGGSSGGS
```

SGGS:

```
                                        (SEQ ID NO: 606)
                   SGGS
```

(GGS)$_3$:

```
                                        (SEQ ID NO: 610)
                GGSGGSGGS
```

The amino acid sequences of the constructs shown in FIG. 109 are set forth below:

BE3:

```
                                        (SEQ ID NO: 174)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
```

-continued

```
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV
```

BE4-pmCDA1:

```
                                        (SEQ ID NO: 175)
MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAVSGSETPGTSESATPESDKKYSIGLAIGTNSVGWAVITDEYKV
PSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVA
YHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIK
PILEKMDGTEELLVKLNREDLLRKQRTFDNGSIPHQIHLGELHAILRRQE
DFYPFLKDNREKIEKILTFRIPYYVGPLARGNSRFAWMTRKSEETITPWN
FEEVVDKGASAQSFIERMTNFDKNLPNEKVLPKHSLLYEYFTVYNELTKV
KYVTEGMRKPAFLSGEQKKAIVDLLFKTNRKVTVKQLKEDYFKKIECFDS
VEISGVEDRFNASLGTYHDLLKIIKDKDFLDNEENEDILEDIVLTLTLFE
DREMIEERLKTYAHLFDDKVMKQLKRRRYTGWGRLSRKLINGIRDKQSGK
TILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNS
RERMKRIEEGIKELGSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
```

-continued

```
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGDSGGSTNLSD
IIEKETGKQLVIQESILMLPEEVEEVIGNKPESDILVHTAYDESTDENVM
LLTSDAPEYKPWALVIQDSNGENKIKMLSGGSPKKKRKV
```

BE4-hAID:

(SEQ ID NO: 176)
```
MDSLLMNRRKFLYQFKNVRWAKGRRETYLCYVVKRRDSATSFSLDFGYLR
NKNGCHVELLFLRYISDWDLDPGRCYRVTWFTSWSPCYDCARHVADFLRG
NPNLSLRIFTARLYFCEDRKAEPEGLRRLHRAGVQIAIMTFKDYFYCWNT
FVENHERTFKAWEGLHENSVRLSRQLRRILLPLYEVDDLRDAFRTLGLSG
SETPGTSESATPESDKKYSIGLAIGTNSVGWAVITDEYKVPSKKFKVLGN
TDRHSIKKNLIGALLFDSGETAEATRLKRTARRRYTRRKNRICYLQEIFS
NEMAKVDDSFFHRLEESFLVEEDKKHERHPIFGNIVDEVAYHEKYPTIYH
LRKKLVDSTDKADLRLIYLALAHMIKFRGHFLIEGDLNPDNSDVDKLFIQ
LVQTYNQLFEENPINASGVDAKAILSARLSKSRRLENLIAQLPGEKKNGL
FGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKA
LVRQQLPEKYKEIFFDQSKNGYAGYIDGGASQEEFYKFIKPILEKMDGTE
ELLVKLNREDLLRKQRTFDNGSIPHQIHLGELHAILRRQEDFYPFLKDNR
EKIEKILTFRIPYYVGPLARGNSRFAWMTRKSEETITPWNFEEVVDKGAS
AQSFIERMTNFDKNLPNEKVLPKHSLLYEYFTVYNELTKVKYVTEGMRKP
AFLSGEQKKAIVDLLFKTNRKVTVKQLKEDYFKKIECFDSVEISGVEDRF
NASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKGI
LQTVKVVDELVKVMGRHKPENIVIEMARENQTTQKGQKNSRERMKRIEEG
IKELGSQILKEHPVENTQLQNEKLYLYYLQNGRDMYVDQELDINRLSDYD
VDHIVPQSFLKDDSIDNKVLTRSDKNRGKSDNVPSEEVVKKMKNYWRQLL
NAKLITQRKFDNLTKAERGGLSELDKAGFIKRQLVETRQITKHVAQILDS
RMNTKYDENDKLIREVKVITLKSKLVSDFRKDFQFYKVREINNYHHAHDA
YLNAVVGTALIKKYPKLESEFVYGDYKVYDVRKMIAKSEQEIGKATAKYF
FYSNIMNFFKTEITLANGEIRKRPLIETNGETGEIVWDKGRDFATVRKVL
SMPQVNIVKKTEVQTGGFSKESILPKRNSDKLIARKKDWDPKKYGGFDSP
TVAYSVLVVAKVEKGKSKKLKSVKELLGITIMERSSFEKNPIDFLEAKGY
KEVKKDLIIKLPKYSLFELENGRKRMLASAGELQKGNELALPSKYVNFLY
LASHYEKLKGSPEDNEQKQLFVEQHKHYLDEIIEQISEFSKRVILADANL
DKVLSAYNKHRDKPIREQAENIIHLFTLTNLGAPAAFKYFDTTIDRKRYT
STKEVLDATLIHQSITGLYETRIDLSQLGGDSGGSTNLSDIIEKETGKQL
VIQESILMLPEEVEEVIGNKPESDILVHTAYDESTDENVMLLTSDAPEYK
PWALVIQDSNGENKIKMLSGGSPKKKRKV
```

BE4-3G:

(SEQ ID NO: 177)
```
MELKYHPEMRFFHWFSKWRKLHRDQEYEVTWYISWSPCTKCTRDMATFLA
EDPKVTLTIFVARLYYFWDPDYQEALRSLCQKRDGPRATMKIMNYDEFQH
CWSKFVYSQRELFEPWNNLPKYYILLHIMLGEILRHSMDPPTFTFNFNNE
PWVRGRHETYLCYEVERMHNDTWVLLNQRRGFLCNQAPHKHGFLEGRHAE
LCFLDVIPFWKLDLDQDYRVTCFTSWSPCFSCAQEMAKFISKNKHVSLCI
FTARIYDDQGRCQEGLRTLAEAGAKISIMTYSEFKHCWDTFVDHQGCPFQ
PWDGLDEHSQDLSGRLRAILQNQENSGSETPGTSESATPESDKKYSIGLA
IGTNSVGWAVITDEYKVPSKKFKVLGNTDRHSIKKNLIGALLFDSGETAE
ATRLKRTARRRYTRRKNRICYLQEIFSNEMAKVDDSFFHRLEESFLVEED
KKHERHPIFGNIVDEVAYHEKYPTIYHLRKKLVDSTDKADLRLIYLALAH
MIKFRGHFLIEGDLNPDNSDVDKLFIQLVQTYNQLFEENPINASGVDAKA
ILSARLSKSRRLENLIAQLPGEKKNGLFGNLIALSLGLTPNFKSNFDLAE
DAKLQLSKDTYDDDLDNLLAQIGDQYADLFLAAKNLSDAILLSDILRVNT
EITKAPLSASMIKRYDEHHQDLTLLKALVRQQLPEKYKEIFFDQSKNGYA
GYIDGGASQEEFYKFIKPILEKMDGTEELLVKLNREDLLRKQRTFDNGSI
PHQIHLGELHAILRRQEDFYPFLKDNREKIEKILTFRIPYYVGPLARGNS
RFAWMTRKSEETITPWNFEEVVDKGASAQSFIERMTNFDKNLPNEKVLPK
HSLLYEYFTVYNELTKVKYVTEGMRKPAFLSGEQKKAIVDLLFKTNRKVT
VKQLKEDYFKKIECFDSVEISGVEDRFNASLGTYHDLLKIIKDKDFLDNE
ENEDILEDIVLTLTLFEDREMIEERLKTYAHLFDDKVMKQLKRRRYTGWG
RLSRKLINGIRDKQSGKTILDFLKSDGFANRNFMQLIHDDSLTFKEDIQK
AQVSGQGDSLHEHIANLAGSPAIKKGILQTVKVVDELVKVMGRHKPENIV
IEMARENQTTQKGQKNSRERMKRIEEGIKELGSQILKEHPVENTQLQNEK
LYLYYLQNGRDMYVDQELDINRLSDYDVDHIVPQSFLKDDSIDNKVLTRS
DKNRGKSDNVPSEEVVKKMKNYWRQLLNAKLITQRKFDNLTKAERGGLSE
LDKAGFIKRQLVETRQITKHVAQILDSRMNTKYDENDKLIREVKVITLKS
KLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKR
PLIETNGETGEIVWDKGRDFATVRKVLSMPQVNIVKKTEVQTGGFSKESI
LPKRNSDKLIARKKDWDPKKYGGFDSPTVAYSVLVVAKVEKGKSKKLKSV
KELLGITIMERSSFEKNPIDFLEAKGYKEVKKDLIIKLPKYSLFELENGR
KRMLASAGELQKGNELALPSKYVNFLYLASHYEKLKGSPEDNEQKQLFVE
QHKHYLDEIIEQISEFSKRVILADANLDKVLSAYNKHRDKPIREQAENII
HLFTLTNLGAPAAFKYFDTTIDRKRYTSTKEVLDATLIHQSITGLYETRI
DLSQLGGDSGGSTNLSDIIEKETGKQLVIQESILMLPEEVEEVIGNKPES
```

-continued

DILVHTAYDESTDENVMLLTSDAPEYKPWALVIQDSNGENKIKMLSGGSP

KKKRKV

BE4-N:

(SEQ ID NO: 178)
MTNLSDIIEKETGKQLVIQESILMLPEEVEEVIGNKPESDILVHTAYDES
TDENVMLLTSDAPEYKPWALVIQDSNGENKIKMLGGSSSETGPVAVDPTL
RRRIEPHEFEVFFDPRELRKETCLLYEINWGGRHSIWRHTSQNTNKHVEV
NFIEKFTTERYFCPNTRCSITWFLSWSPCGECSRAITEFLSRYPHVTLFI
YIARLYHHADPRNRQGLRDLISSGVTIQIMTEQESGYCWRNFVNYSPSNE
AHWPRYPHLWVRLYVLELYCIILGLPPCLNILRRKQPQLTFFTIALQSCH
YQRLPPHILWATGLKSGSETPGTSESATPESDKKYSIGLAIGTNSVGWAV
ITDEYKVPSKKFKVLGNTDRHSIKKNLIGALLFDSGETAEATRLKRTARR
RYTRRKNRICYLQEIFSNEMAKVDDSFFHRLEESFLVEEDKKHERHPIFG
NIVDEVAYHEKYPTIYHLRKKLVDSTDKADLRLIYLALAHMIKFRGHFLI
EGDLNPDNSDVDKLFIQLVQTYNQLFEENPINASGVDAKAILSARLSKSR
RLENLIAQLPGEKKNGLFGNLIALSLGLTPNFKSNFDLAEDAKLQLSKDT
YDDDLDNLLAQIGDQYADLFLAAKNLSDAILLSDILRVNTEITKAPLSAS
MIKRYDEHHQDLTLLKALVRQQLPEKYKEIFFDQSKNGYAGYIDGGASQE
EFYKFIKPILEKMDGTEELLVKLNREDLLRKQRTFDNGSIPHQIHLGELH
AILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFK
KIECFDSVEISGVEDRFNASLGTYHDLLKIIKDKDFLDNEENEDILEDIV
LTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSL
HEHIANLAGSPAIKKGILQTVKVVDELVKVMGRHKPENIVIEMARENQTT
QKGQKNSRERMKRIEEGIKELGSQILKEHPVENTQLQNEKLYLYYLQNGR
DMYVDQELDINRLSDYDVDHIVPQSFLKDDSIDNKVLTRSDKNRGKSDNV
PSEEVVKKMKNYWRQLLNAKLITQRKFDNLTKAERGGLSELDKAGFIKRQ
LVETRQITKHVAQILDSRMNTKYDENDKLIREVKVITLKSKLVSDFRKDF
QFYKVREINNYHHAHDAYLNAVVGTALIKKYPKLESEFVYGDYKVYDVRK
MIAKSEQEIGKATAKYFFYSNIMNFFKTEITLANGEIRKRPLIETNGETG
EIVWDKGRDFATVRKVLSMPQVNIVKKTEVQTGGFSKESILPKRNSDKLI
ARKKDWDPKKYGGFDSPTVAYSVLVVAKVEGKSKKLKSVKELLGITIME
RSSFEKNPIDFLEAKGYKEVKKDLIIKLPKYSLFELENGRKRMLASAGEL
QKGNELALPSKYVNFLYLASHYEKLKGSPEDNEQKQLFVEQHKHYLDEII
EQISEFSKRVILADANLDKVLSAYNKHRDKPIREQAENIIHLFTLTNLGA
PAAFKYFDTTIDRKRYTSTKEVLDATLIHQSITGLYETRIDLSQLGGDSG
GSPKKKRKV

BE4-SSB:

(SEQ ID NO: 179)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGGSGGSGGSASRGVNKVILVGNLGQDPEVRYMPNGGA
VANITLATSESWRDKATGEMKEQTEWHRVVLFGKLAEVASEYLRKGSQVY
IEGQLRTRKWTDQSGQDRYTTEVVVNVGGTMQMLGGRQGGGAPAGGNIGG
GQPQGGWGQPQQPQGGNQFSGGAQSRPQQSAPAAPSNEPPMDFDDDIPFS
GGSPKKKRKV

BE4-(GGS)₃:

(SEQ ID NO: 180)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGSGGSGGSTNLSDIIEKETGKQLVIQESILMLPEEV
EEVIGNKPESDILVHTAYDESTDENVMLLTSDAPEYKPWALVIQDSNGEN
KIKMLSGGSPKKKRKV

BE4-XTEN:

(SEQ ID NO: 181)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGSETPGTSESATPESTNLSDIIEKETGKQLVIQESIL
MLPEEVEEVIGNKPESDILVHTAYDESTDENVMLLTSDAPEYKPWALVIQ
DSNGENKIKMLSGGSPKKKRKV

BE4-32aa:

(SEQ ID NO: 182)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGGSSGGSSGSETPGTSESAT

-continued

PESSGGSSGGSDKKYSIGLAIGTNSVGWAVITDEYKVPSKKFKVLGNTDR
HSIKKNLIGALLFDSGETAEATRLKRTARRRYTRRKNRICYLQEIFSNEM
AKVDDSFFHRLEESFLVEEDKKHERHPIFGNIVDEVAYHEKYPTIYHLRK
KLVDSTDKADLRLIYLALAHMIKFRGHFLIEGDLNPDNSDVDKLFIQLVQ
TYNQLFEENPINASGVDAKAILSARLSKSRRLENLIAQLPGEKKNGLFGN
LIALSLGLTPNFKSNFDLAEDAKLQLSKDTYDDDLDNLLAQIGDQYADLF
LAAKNLSDAILLSDILRVNTEITKAPLSASMIKRYDEHHQDLTLLKALVR
QQLPEKYKEIFFDQSKNGYAGYIDGGASQEEFYKFIKPILEKMDGTEELL
VKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNAS
LGTYHDLLKIIKDKDFLDNEENEDILEDIVLTLTLFEDREMIEERLKTYA
HLFDDKVMKQLKRRRYTGWGRLSRKLINGIRDKQSGKTILDFLKSDGFAN
RNFMQLIHDDSLTFKEDIQKAQVSGQGDSLHEHIANLAGSPAIKKGILQT
VKVVDELVKVMGRHKPENIVIEMARENQTTQKGQKNSRERMKRIEEGIKE
LGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAK
LITQRKFDNLTKAERGGLSELDKAGFIKRQLVETRQITKHVAQILDSRMN
TKYDENDKLIREVKVITLKSKLVSDFRKDFQFYKVREINNYHHAHDAYLN
AVVGTALIKKYPKLESEFVYGDYKVYDVRKMIAKSEQEIGKATAKYFFYS
NIMNFFKTEITLANGEIRKRPLIETNGETGEIVWDKGRDFATVRKVLSMP
QVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEV
KKDLIIKLPKYSLFELENGRKRMLASAGELQKGNELALPSKYVNFLYLAS
HYEKLKGSPEDNEQKQLFVEQHKHYLDEIIEQISEFSKRVILADANLDKV
LSAYNKHRDKPIREQAENIIHLFTLTNLGAPAAFKYFDTTIDRKRYTSTK
EVLDATLIHQSITGLYETRIDLSQLGGDSGGSTNLSDIIEKETGKQLVIQ
ESILMLPEEVEEVIGNKPESDILVHTAYDESTDENVMLLTSDAPEYKPWA
LVIQDSNGENKIKMLSGGSPKKKRKV

BE4-2XUGI:

(SEQ ID NO: 183)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL

-continued

ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSTNLSDIIEKETGKQLVIQESILMLPEEVEEVIGNKPESDILVHTAYD
ESTDENVMLLTSDAPEYKPWALVIQDSNGENKIKMLSGGSPKKKRKV

BE4:

(SEQ ID NO: 184)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGGSSGGSSGGSETPGTSESAT
PESSGGSSGGSDKKYSIGLAIGTNSVGWAVITDEYKVPSKKFKVLGNTDR
HSIKKNLIGALLFDSGETAEATRLKRTARRRYTRRKNRICYLQEIFSNEM
AKVDDSFFHRLEESFLVEEDKKHERHPIFGNIVDEVAYHEKYPTIYHLRK
KLVDSTDKADLRLIYLALAHMIKFRGHFLIEGDLNPDNSDVDKLFIQLVQ
TYNQLFEENPINASGVDAKAILSARLSKSRRLENLIAQLPGEKKNGLFGN

-continued

LIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFAN

RNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKE

LGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMN

TKYDENDKLIREVKVITLKSKLVSDFRKDFQFYKVREINNYHHAHDAYLN

AVVGTALIKKYPKLESEFVYGDYKVYDVRKMIAKSEQEIGKATAKYFFYS

NIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEV

KKDLIIKLPKYSLFELENGRKRMLASAGELQKGNELALPSKYVNFLYLAS

HYEKLKGSPEDNEQKQLFVEQHKHYLDEIIEQISEFSKRVILADANLDKV

LSAYNKHRDKPIREQAENIIHLFTLTNLGAPAAFKYFDTTIDRKRYTSTK

EVLDATLIHQSITGLYETRIDLSQLGGDSGGSGGSGGSTNLSDIIEKETG

KQLVIQESILMLPEEVEEVIGNKPESDILVHTAYDESTDENVMLLTSDAP

EYKPWALVIQDSNGENKIKMLSGGSGGSGGSTNLSDIIEKETGKQLVIQE

SILMLPEEVEEVIGNKPESDILVHTAYDESTDENVMLLTSDAPEYKPWAL

VIQDSNGENKIKMLSGGSPKKKRKV

The ability of the base editing constructs of FIG. 109 to mutate target cytosine residues of EMX1, FANCF, HEK2, HEK3, HEK4, and RNF2 are shown in FIGS. 110-115. The percentage of target cytosines edited (including the proportion of C residues that are mutated to a T, A, or G), as well as the % of indels generated, are shown in FIGS. 110-115. The percentage of target cytosines edited were calculated using the following formula: 100−[% of sequencing reads with C]. The pie charts of FIGS. 110-115 show the distribution of reads with the various bases indicated, meaning that looking at all of the base edited reads (reads that have a nucleotide other than a C at the base indicated), what percentage of those have A, G, or T. Tables 9-14, below, show the values of the mutation percentages that are indicated by in the pie charts of FIGS. 110-115.

The C to non-T editing observed is likely due to UDG (uracil DNA glycosylase). For example, once the C is converted to the uracil intermediate, UDG can convert it to an abasic site. This abasic site is then processed by other endogenous enzymes and ultimately leads to indels or other bases (such as G or A) replacing the C. We have shown that in UDG knock-out cell lines show increased C to T editing with little to no indels at all.

TABLE 9

EMX1

| EMX1 | | $C_5$ |
|---|---|---|
| BE3 | A | 1.9% |
| | C | 51.9% |
| | G | 6.0% |
| | T | 40.3% |
| pmCDA1 | A | 0.2% |
| | C | 88.9% |
| | G | 0.8% |
| | T | 10.0% |
| hAID | A | 0.3% |
| | C | 83.6% |
| | G | 0.6% |
| | T | 15.4% |
| hAPOBEC3G | A | 0.0% |
| | C | 98.9% |
| | G | 0.2% |
| | T | 1.0% |
| BE4-N | A | 1.4% |
| | C | 85.6% |
| | G | 3.5% |
| | T | 9.5% |
| BE4-SSB | A | 0.3% |
| | C | 96.7% |
| | G | 0.7% |
| | T | 2.3% |
| BE4-(GGS)$_3$ | A | 1.7% |
| | C | 36.8% |
| | G | 4.1% |
| | T | 57.4% |
| BE4-XTEN | A | 2.1% |
| | C | 45.7% |
| | G | 5.1% |
| | T | 47.1% |
| BE4-32aa | A | 1.6% |
| | C | 46.3% |
| | G | 4.6% |
| | T | 47.5% |
| BE4-2XUGI | A | 0.6% |
| | C | 60.2% |
| | G | 1.9% |
| | T | 37.3% |

TABLE 10

FANCF

| FANCF | | $C_8$ |
|---|---|---|
| BE3 | A | 1.6% |
| | C | 74.4% |
| | G | 0.7% |
| | T | 23.3% |
| pmCDA1 | A | 0.5% |
| | C | 88.8% |
| | G | 0.3% |
| | T | 10.3% |
| hAID | A | 0.3% |
| | C | 89.6% |
| | G | 0.2% |
| | T | 9.9% |
| hAPOBEC3G | A | 2.1% |
| | C | 75.4% |
| | G | 10.4% |
| | T | 12.1% |

TABLE 10-continued

| FANCF | | |
|---|---|---|
| FANCF | | $C_8$ |
| BE4-N | A | 1.8% |
| | C | 83.5% |
| | G | 0.6% |
| | T | 14.2% |
| BE4-SSB | A | 0.3% |
| | C | 97.1% |
| | G | 0.1% |
| | T | 2.6% |
| BE4-(GGS)$_3$ | A | 2.3% |
| | C | 45.7% |
| | G | 1.4% |
| | T | 50.6% |
| BE4-XTEN | A | 1.1% |
| | C | 56.3% |
| | G | 0.4% |
| | T | 42.1% |
| BE4-32aa | A | 1.2% |
| | C | 70.0% |
| | G | 0.6% |
| | T | 28.2% |
| BE4-2XUGI | A | 0.9% |
| | C | 57.8% |
| | G | 1.1% |
| | T | 40.2% |

TABLE 11

| HEK2 | | |
|---|---|---|
| HEK2 | | $C_6$ |
| BE3 | A | 0.9% |
| | C | 28.2% |
| | G | 52.9% |
| | T | 18.1% |
| pmCDA1 | A | 1.8% |
| | C | 73.5% |
| | G | 3.5% |
| | T | 21.2% |
| hAID | A | 2.1% |
| | C | 56.9% |
| | G | 7.7% |
| | T | 33.3% |
| hAPOBEC3G | A | 0.1% |
| | C | 86.5% |
| | G | 9.9% |
| | T | 3.5% |
| BE4-N | A | 1.0% |
| | C | 37.6% |
| | G | 57.0% |
| | T | 4.4% |
| BE4-SSB | A | 0.2% |
| | C | 78.4% |
| | G | 20.0% |
| | T | 1.4% |
| BE4-(GGS)$_3$ | A | 0.6% |
| | C | 11.1% |
| | G | 40.6% |
| | T | 47.7% |
| BE4-XTEN | A | 1.2% |
| | C | 24.8% |
| | G | 44.6% |
| | T | 29.4% |
| BE4-32aa | A | 1.1% |
| | C | 26.3% |
| | G | 41.8% |
| | T | 30.7% |
| BE4-2XUGI | A | 0.8% |
| | C | 37.0% |
| | G | 21.6% |
| | T | 40.6% |

TABLE 12

| HEK3 | | |
|---|---|---|
| HEK3 | | $C_5$ |
| BE3 | A | 2.23% |
| | C | 38.06% |
| | G | 12.77% |
| | T | 46.95% |
| pmCDA1 | A | 0.21% |
| | C | 76.57% |
| | G | 0.12% |
| | T | 23.09% |
| hAID | A | 0.28% |
| | C | 60.23% |
| | G | 1.03% |
| | T | 38.45% |
| hAPOBEC3G | A | 3.11% |
| | C | 33.89% |
| | G | 28.59% |
| | T | 34.41% |
| BE4-N | A | 2.6% |
| | C | 64.1% |
| | G | 13.5% |
| | T | 19.8% |
| BE4-SSB | A | 0.4% |
| | C | 92.9% |
| | G | 2.8% |
| | T | 3.9% |
| BE4-(GGS)$_3$ | A | 1.3% |
| | C | 9.9% |
| | G | 7.9% |
| | T | 80.8% |
| BE4-XTEN | A | 2.3% |
| | C | 15.9% |
| | G | 12.2% |
| | T | 69.6% |
| BE4-32aa | A | 1.3% |
| | C | 14.9% |
| | G | 9.9% |
| | T | 73.9% |
| BE4-2XUGI | A | 0.6% |
| | C | 23.4% |
| | G | 3.8% |
| | T | 72.2% |

TABLE 13

| HEK4 | | |
|---|---|---|
| HEK4 | | $C_5$ |
| BE3 | A | 8.40% |
| | C | 41.89% |
| | G | 24.54% |
| | T | 25.17% |
| pmCDA1 | A | 0.50% |
| | C | 87.53% |
| | G | 0.01% |
| | T | 11.95% |
| hAID | A | 0.93% |
| | C | 71.32% |
| | G | 0.69% |
| | T | 27.06% |
| hAPOBEC3G | A | 0.12% |
| | C | 99.37% |
| | G | 0.35% |
| | T | 0.16% |
| BE4-N | A | 7.3% |
| | C | 56.6% |
| | G | 25.7% |
| | T | 10.3% |
| BE4-SSB | A | 2.1% |
| | C | 86.8% |
| | G | 5.8% |
| | T | 5.2% |

TABLE 13-continued

HEK4

| HEK4 | | $C_5$ |
|---|---|---|
| BE4-(GGS)$_3$ | A | 6.7% |
| | C | 13.0% |
| | G | 19.8% |
| | T | 60.5% |
| BE4-XTEN | A | 7.5% |
| | C | 19.7% |
| | G | 25.4% |
| | T | 47.4% |
| BE4-32aa | A | 7.9% |
| | C | 21.8% |
| | G | 25.1% |
| | T | 45.3% |
| BE4-2XUGI | A | 3.4% |
| | C | 22.2% |
| | G | 12.4% |
| | T | 62.0% |

TABLE 14

RNF2

| RNF2 | | $C_6$ |
|---|---|---|
| BE3 | A | 2.46% |
| | C | 46.65% |
| | G | 19.87% |
| | T | 31.03% |
| pmCDA1 | A | 0.60% |
| | C | 83.52% |
| | G | 1.33% |
| | T | 14.55% |
| hAID | A | 0.36% |
| | C | 75.03% |
| | G | 3.20% |
| | T | 21.40% |
| hAPOBEC3G | A | 0.10% |
| | C | 86.60% |
| | G | 3.70% |
| | T | 9.59% |
| BE4-N | A | 5.1% |
| | C | 50.0% |
| | G | 28.8% |
| | T | 16.2% |
| BE4-SSB | A | 1.1% |
| | C | 89.9% |
| | G | 4.9% |
| | T | 4.1% |
| BE4-(GGS)$_3$ | A | 2.0% |
| | C | 23.0% |
| | G | 14.0% |
| | T | 61.0% |
| BE4-XTEN | A | 2.6% |
| | C | 32.4% |
| | G | 16.0% |
| | T | 49.0% |
| BE4-32aa | A | 2.2% |
| | C | 29.2% |
| | G | 18.5% |
| | T | 50.0% |
| BE4-2XUGI | A | 0.7% |
| | C | 45.0% |
| | G | 6.5% |
| | T | 47.8% |

Example 15: Base Editors Comprising a Cpf1 Nickase that Cleaves the Targeted Strand As discussed above, nucleic acid programmable DNA binding proteins (napDNAbp) of any of the fusion proteins provided herein may be a Cpf1 protein. In some embodiments, the Cpf1 protein is a Cpf1 nickase (nCpf1). Cpf1 nickases, for example, a Cpf1 nickase (R1225A in AsCpf1; and R1138A in LbCpf1) that cleaves the non-target strand have been described in Yamano et al., "Crystal structure of Cpf1 in complex with guide RNA and target DNA." Cell (165) 2016, p. 949-962; the entire contents of which is hereby incorporated by reference. However, a nickase (e.g., a Cpf1 nickase of a base editor protein) that cleaves the target strand is expected to improve base editing efficiency.

A fluorescent labeled DNA was used to identify a Cpf1 mutant that preferentially nicks the target strand, rather than the non-target strand (see FIG. 116). In FIG. 116, the top strand of DNA constructs 1-3, is the non-target strand and the bottom strand is the target strand. An in vitro assay is carried out using wild-type LbCpf1, R836A (LbCpf1), and R1138A (LbCpf1). R836A (LbCpf1) appears to be a "crippled" nickase, meaning it cuts the target strand more efficiently than the non-target strand. As shown in FIG. 117, the non-target strand is uncut, no fluorescent 350 piece is observed. After two hours, both strands are cut. Differing intensities suggest more target strands are cut than non-target strands.

Establishing a Base Editing Window with AsCp1-BE3

Base editing proteins (e.g., BE3 (SpCas9-BE3)) having LbCpf1(R836A) or AsCpf1(R912A) as the napDNAbp were shown to edit bases at low efficiency (0.1% to 0.4%). A base editor with a AsCpf1 (R912A) napDNAbp more efficiently mutated a target C at EMX1, FANCF, HEK3 and HEK4 sites. The editing window of the constructs tested appears to be from the 7$^{th}$ base to the 11$^{th}$ base. The numbers are consistent with the trend with BE3 having highest numbers and self-defeating BE (i.e., APOBEC-AsCpf1(R1225A)-UGI, which cleaves the non-target strand) having lower ones. See FIG. 118 Positive control with Cas9-BE3 on EMX1: 5-6%. Indel values for AsCpf1: >20%. R912 in AsCpf1 is conserved across many members of the Cpf1 family. The corresponding residue in LbCpf1 is R836, which is believed to be a "crippled" nickase when the R is mutated to an A.

Optimization of Cpf1-BE (Linkers)

Indel data suggests that Cpf1 can access DNA target sites. Thus, optimization of Cpf1 base editing proteins has focused on specific APOBEC proteins, linkers, and/or UGI domains. The construct shown in FIG. 119 was tested, with varying linkers using both LbCpf1(R836A) and AsCpf1(R912A). In short, different linker sequences (i.e., XTEN, GGS, (GGS)$_3$ (SEQ ID NO: 610), (GGS)$_5$ (SEQ ID NO: 610), and (GGS)$_7$ (SEQ ID NO: 610)) between the APOBEC and Cpf1 domain (e.g., AsCpf1 or LbCpf1) were tested. See FIG. 120. The constructs were tested for their ability to mutate the $C_8$ residue of the HEK3 site, which is TGCTTCTC$_8$CAGCCCTGGCCTGG (SEQ ID NO: 592). Editing levels for base editing proteins with AsCpf1 reached to over 1%, while base editing proteins with LbCpf1 showed a comparative reduction in base editing efficiency. As shown in FIG. 121, linkers from a database maintained by the Centre of Integrative Bioinformatics VU did not show as significant an improvement as GGS-type linkers for AsCpf1-BE3. The linkers shown in FIG. 121 are shown below:

| PDB_code | Length (aa) | Sequence | |
|---|---|---|---|
| 1au7A_1 | 10 | KRRTTISIAA | (SEQ ID NO: 593) |
| 1clkA_1 | 19 | ALVFYREYIGRLKQIKFKF | (SEQ ID NO: 594) |

-continued

| PDB_code | Length (aa) | Sequence | |
|---|---|---|---|
| 1c20A_1 | 14 | LPIMAKSVLDLYEL | (SEQ ID NO: 595) |
| 1ee8A_1 | 5 | LLRLG | (SEQ ID NO: 596) |
| 1f1zA_1 | 15 | TDKEINPVVKENIEW | (SEQ ID NO: 597) |
| 1ignA_1 | 8 | PPSIKRKF | (SEQ ID NO: 598) |
| 1jmcA_1 | 9 | LPTVQFDFT | (SEQ ID NO: 599) |
| 1sfe_1 | 14 | LPLDIRGTAFQQQV | (SEQ ID NO: 600) |
| 2ezx_1 | 8 | AYVVLGQF | (SEQ ID NO: 601) |
| 2reb_1 | 8 | INFYGELV | (SEQ ID NO: 602) |

Optimization of Cpf1-BE (Orientations)

Cas9 has a stretch of amino acids between the C and N termini (see red square, FIG. 123) while AsCpf1 does not (see FIG. 122). Moreover, AsCpf1 has a shorter distance between the N and C termini. These observations indicate potential interference between APOBEC (on N terminus) and UGI (on C terminus) through which UGI may hinder APOBEC access to the non-target strand. One solution is to move APOBEC and UGI onto the same terminus, either N or C. Accordingly, constructs having the architecture NLS-UGI-APOBEC-XTEN-AsCpf1; UGI-APOBEC-XTEN-AsCpf1-NLS; and AsCpf1-XTEN-APOBEC-NLS will be tested.

Optimization of Cpf1-BE (Internal Truncation)

There is no known crystal structure of Cpf1 in which the non-target strand is resolved (see FIG. 124, cyan). It is believed that the editing window should lie within the red circle as shown in FIG. 124. There is a helical region (see square in FIG. 124) that may be obstructing APOBEC. This region comprises the amino acid sequence K(661)KTGDQK(667) (SEQ ID NO: 603).

To test the whether the removal of two, four or six residues improves base editing efficiency, experiments were conducted with a base editor having a AsCpf1(R912A) napDNAbp, using HEK3 as the target site. Editing levels increase to approximately 2.6%—a 6-fold increase from control levels when T663 and D665 are deleted (see Table 7, below). The construct used in this experiment was APOBEC-XTEN-AsCpf1(R912A)-SGGS-UGI

TABLE 7

| Deletions | Editing at C8 | Editing at C9 |
|---|---|---|
| T663, D665 | 2.59% | 1.29% |
| K662, T663, D665, Q666 | 0.15% | 0.15% |
| K661, K662, T663, D665, Q666, K667 | 0.22% | 0.21% |

REFERENCES

1. Humbert O, Davis L, Maizels N. Targeted gene therapies: tools, applications, optimization. Crit Rev Biochem Mol. 2012; 47(3):264-81. PMID: 22530743.
2. Perez-Pinera P, Ousterout D G, Gersbach C A. Advances in targeted genome editing. Curr Opin Chem Biol. 2012; 16(3-4):268-77. PMID: 22819644.
3. Urnov F D, Rebar E J, Holmes M C, Zhang H S, Gregory P D. Genome editing with engineered zinc finger nucleases. Nat Rev Genet. 2010; 11(9):636-46. PMID: 20717154.
4. Joung J K, Sander J D. TALENs: a widely applicable technology for targeted genome editing. Nat Rev Mol Cell Biol. 2013; 14(1):49-55. PMID: 23169466.
5. Charpentier E, Doudna J A. Biotechnology: Rewriting a genome. Nature. 2013; 495, (7439):50-1. PMID: 23467164.
6. Pan Y, Xia L, Li A S, Zhang X, Sirois P, Zhang J, Li K. Biological and biomedical applications of engineered nucleases. Mol Biotechnol. 2013; 55(1):54-62. PMID: 23089945.
7. De Souza, N. Primer: genome editing with engineered nucleases. Nat Methods. 2012; 9(1):27. PMID: 22312638.
8. Santiago Y, Chan E, Liu P Q, Orlando S, Zhang L, Urnov F D, Holmes M C, Guschin D, Waite A, Miller J C, Rebar E J, Gregory P D, Klug A, Collingwood T N. Targeted gene knockout in mammalian cells by using engineered zinc-finger nucleases. Proc Natl Acad Sci USA. 2008; 105(15):5809-14. PMID: 18359850.
9. Cargill M, Altshuler D, Ireland J, Sklar P, Ardlie K, Patil N, Lane C R, Lim E P, Kalyanaraman N, Nemesh J, Ziaugra L, Friedland L, Rolfe A, Warrington J, Lipshutz R, Daley G Q, Lander E S. Characterization of single-nucleotide polymorphisms in coding regions of human genes. Nat Genet. 1999; 22(3):231-8. PMID: 10391209.
10. Jansen R, van Embden J D, Gaastra W, Schouls L M. Identification of genes that are associated with DNA repeats in prokaryotes. Mol Microbiol. 2002; 43(6):1565-75. PMID: 11952905.
11. Mali P, Esvelt K M, Church G M. Cas9 as a versatile tool for engineering biology. Nat Methods. 2013; 10(10):957-63. PMID: 24076990.
12. Jore M M, Lundgren M, van Duijin E, Bultema J B, Westra E R, Waghmare S P, Wiedenheft B, Pul U, Wurm R, Wagner R, Beijer M R, Barendregt A, Shou K, Snijders A P, Dickman M J, Doudna J A, Boekema E J, Heck A J, van der Oost J, Brouns S J. Structural basis for CRISPR RNA-guided DNA recognition by Cascade. Nat Struct Mol Biol. 2011; 18(5):529-36. PMID: 21460843.
13. Horvath P, Barrangou R. CRISPR/Cas, the immune system of bacteria and archaea. Science. 2010; 327(5962): 167-70. PMID: 20056882.
14. Wiedenheft B, Sternberg S H, Doudna J A. RNA-guided genetic silencing systems in bacteria and archaea. Nature. 2012; 482(7385):331-8. PMID: 22337052.
15. Gasiunas G, Siksnys V. RNA-dependent DNA endonuclease Cas9 of the CRISPR system: Holy Grail of genome editing? Trends Microbiol. 2013; 21(11):562-7. PMID: 24095303.
16. Qi L S, Larson M H, Gilbert L A, Doudna J A, Weissman J S, Arkin A P, Lim W A. Repurposing CRISPR as an RNA-guided platform for sequence-specific control of gene expression. Cell. 2013; 152(5):1173-83. PMID: 23452860.
17. Perez-Pinera P, Kocak D D, Vockley C M, Adler A F, Kabadi A M, Polstein L R, Thakore P I, Glass K A, Ousterout D G, Leong K W, Guilak F, Crawford G E, Reddy T E, Gersbach C A. RNA-guided gene activation by CRISPR-Cas9-based transcription factors. Nat Methods. 2013; 10(10):973-6. PMID: 23892895.
18. Mali P, Aach J, Stranges P B, Esvelt K M, Moosburner M, Kosuri S, Yang L, Church G M. CAS9 transcriptional activators for target specificity screening and paired nickases for cooperative genome engineering. Nat Biotechnol. 2013; 31(9):833-8. PMID: 23907171.
19. Gilbert L A, Larson M H, Morsut L, Liu Z, Brar G A, Torres S E, Stern-Ginossar N, Brandman O, Whitehead E H, Doudna J A, Lim W A, Weissman J S, Qi L S. CRISPR-mediated modular RNA-guided regulation of transcription in eukaryotes. *Cell*. 2013; 154(2):442-51. PMID: 23849981.

20. Larson M H, Gilbert L A, Wang X, Lim W A, Weissman J S, Qi L S. CRISPR interference (CRISPRi) for sequence-specific control of gene expression. *Nat Protoc*. 2013; 8(11):2180-96. PMID: 24136345.

21. Mali P, Yang L, Esvelt K M, Aach J, Guell M, DiCarlo J E, Norville J E, Church G M. RNA-guided human genome engineering via Cas9. *Science*. 2013; 339(6121): 823-6. PMID: 23287722.

22. Cole-Strauss A, Yoon K, Xiang Y, Byrne B C, Rice M C, Gryn J, Holloman W K, Kmiec E B. Correction of the mutation responsible for sickle cell anemia by an RNA-DNA oligonucleotide. *Science*. 1996; 273(5280):1386-9. PMID: 8703073.

23. Tagalakis A D, Owen J S, Simons J P. Lack of RNA-DNA oligonucleotide (chimeraplast) mutagenic activity in mouse embryos. *Mol Reprod Dev*. 2005; 71(2):140-4. PMID: 15791601.

24. Ray A, Langer M. Homologous recombination: ends as the means. *Trends Plant Sci*. 2002; 7(10):435-40. PMID 12399177.

25. Britt A B, May G D. Re-engineering plant gene targeting. *Trends Plant Sci*. 2003; 8(2):90-5. PMID: 12597876.

26. Vagner V, Ehrlich S D. Efficiency of homologous DNA recombination varies along the *Bacillus subtilis* chromosome. *J Bacteriol*. 1988; 170(9):3978-82. PMID: 3137211.

27. Saleh-Gohari N, Helleday T. Conservative homologous recombination preferentially repairs DNA double-strand breaks in the S phase of the cell cycle in human cells. *Nucleic Acids Res*. 2004; 32(12):3683-8. PMID: 15252152.

28. Lombardo A, Genovese P, Beausejour C M, Colleoni S, Lee Y L, Kim K A, Ando D, Urnov F D, Galli C, Gregory P D, Holmes M C, Naldini L. Gene editing in human stem cells using zinc finger nucleases and integrase-defective lentiviral vector delivery. *Nat Biotechnol*. 2007; 25(11): 1298-306. PMID: 17965707.

29. Conticello S G. The AID/APOBEC family of nucleic acid mutators. *Genome Biol*. 2008; 9(6):229. PMID: 18598372.

30. Reynaud C A, Aoufouchi S, Faili A, Weill J C. What role for AID: mutator, or assembler of the immunoglobulin mutasome? *Nat Immunol*. 2003; 4(7):631-8.

31. Bhagwat A S. DNA-cytosine deaminases: from antibody maturation to antiviral defense. *DNA Repair (Amst)*. 2004; 3(1):85-9. PMID: 14697763.

32. Navaratnam N, Sarwar R. An overview of cytidine deaminases. *Int J Hematol*. 2006; 83(3):195-200. PMID: 16720547.

33. Holden L G, Prochnow C, Chang Y P, Bransteitter R, Chelico L, Sen U, Stevens R C, Goodman M F, Chen X S. Crystal structure of the anti-viral APOBEC3G catalytic domain and functional implications. *Nature*. 2008; 456 (7218):121-4. PMID: 18849968.

34. Chelico L, Pham P, Petruska J, Goodman M F. Biochemical basis of immunological and retroviral responses to DNA-targeted cytosine deamination by activation-induced cytidine deaminase and APOBEC3G. *J Biol Chem*. 2009; 284(41). 27761-5. PMID: 19684020.

35. Pham P, Bransteitter R, Goodman M F. Reward versus risk: DNA cytidine deaminases triggering immunity and disease. *Biochemistry*. 2005; 44(8):2703-15. PMID 15723516.

36. Chen X, Zaro J L, Shen W C. Fusion protein linkers: property, design and functionality. *Adv Drug Deliv Rev*. 2013; 65(10):1357-69. PMID: 23026637.

37. Lee J W, Soung Y H, Kim S Y, Lee H W, Park W S, Nam S W, Kim S H, Lee J Y, Yoo N J, Lee S H. PIK3CA gene is frequently mutated in breast carcinomas and hepatocellular carcinomas. *Oncogene*. 2005; 24(8):1477-80. PMID: 15608678.

38. Ikediobi O N, Davies H, Bignell G, Edkins S, Stevens C, O'Meara S, Santarius T, Avis T, Barthorpe S, Brackenbury L, Buck G, Butler A, Clements J, Cole J, Dicks E, Forbes S, Gray K, Halliday K, Harrison R, Hills K, Hinton J, Hunter C, Jenkinson A, Jones D, Kosmidou V, Lugg R, Menzies A, Mironenko T, Parker A, Perry J, Raine K, Richardson D, Shepherd R, Small A, Smith R, Solomon H, Stephens P, Teague J, Tofts C, Varian J, Webb T, West S, Widaa S, Yates A, Reinhold W, Weinstein J N, Stratton M R, Futreal P A, Wooster R. Mutation analysis of 24 known cancer genes in the NCI-60 cell line set. *Mol Cancer Ther*. 2006; 5(11):2606-12. PMID: 17088437.

39. Cox, D. B., Platt, R. J. & Zhang, F. Therapeutic genome editing: prospects and challenges. *Nature medicine* 21, 121-131, doi:10.1038/nm.3793 (2015).

40. Hilton, I. B. & Gersbach, C. A. Enabling functional genomics with genome engineering. *Genome research* 25, 1442-1455, doi:10.1101/gr.190124.115 (2015).

41. Sander, J. D. & Joung, J. K. CRISPR-Cas systems for editing, regulating and targeting genomes. *Nature biotechnology* 32, 347-355, doi:10.1038/nbt.2842 (2014).

42. Maruyama, T. et al. Increasing the efficiency of precise genome editing with CRISPR-Cas9 by inhibition of non-homologous end joining. *Nature biotechnology* 33, 538-542, doi:10.1038/nbt.3190 (2015).

43. Chu, V. T. et al. Increasing the efficiency of homology-directed repair for CRISPR-Cas9-induced precise gene editing in mammalian cells. *Nature biotechnology* 33, 543-548, doi:10.1038/nbt.3198 (2015).

44. Lin, S., Staahl, B. T., Alla, R. K. & Doudna, J. A. Enhanced homology-directed human genome engineering by controlled timing of CRISPR/Cas9 delivery. *eLife* 3, e04766, doi:10.7554/eLife.04766 (2014).

45. Cong, L. et al. Multiplex genome engineering using CRISPR/Cas systems. *Science* 339, 819-823, doi: 10.1126/science.1231143 (2013).

46. Rong, Z., Zhu, S., Xu, Y. & Fu, X. Homologous recombination in human embryonic stem cells using CRISPR/Cas9 nickase and a long DNA donor template. *Protein & cell* 5, 258-260, doi:10.1007/s13238-014-0032-5 (2014).

47. Jinek, M. et al. A Programmable Dual-RNA-Guided DNA Endonuclease in Adaptive Bacterial Immunity. *Science* 337, 816-821, doi:10.1126/science.1225829 (2012).

48. Harris, R. S., Petersen-Mahrt, S. K. & Neuberger, M. S. RNA Editing Enzyme APOBEC1 and Some of Its Homologs Can Act as DNA Mutators. *Molecular Cell* 10, 1247-1253 (2002).

49. Jinek, M. et al. Structures of Cas9 endonucleases reveal RNA-mediated conformational activation. *Science* 343, 1247997, doi:10.1126/science.1247997 (2014).

50. Schellenberger, V. et al. A recombinant polypeptide extends the in vivo half-life of peptides and proteins in a tunable manner. *Nature biotechnology* 27, 1186-1190, doi:10.1038/nbt.1588 (2009).

51. Saraconi, G., Severi, F., Sala, C., Mattiuz, G. & Conticello, S. G. The RNA editing enzyme APOBEC1 induces somatic mutations and a compatible mutational signature is present in esophageal adenocarcinomas. *Genome biology* 15, 417-(2014).

52. Anders, C., Niewoehner, O., Duerst, A. & Jinek, M. Structural basis of PAM-dependent target DNA recognition by the Cas9 endonuclease. *Nature* 513, 569-573, doi:10.1038/nature13579 (2014).

53. Cong, L. et al. Multiplex genome engineering using CRISPR/Cas systems. *Science* 339, 819-823 (2013).

54. Tsai, S. Q. et al. GUIDE-seq enables genome-wide profiling of off-target cleavage by CRISPR-Cas nucleases. *Nature biotechnology* 33, 187-197, doi:10.1038/nbt.3117 (2015).

55. Kunz, C., Saito, Y. & Schar, P. DNA Repair in mammalian cells: Mismatched repair: variations on a theme. *Cellular and molecular life sciences: CMLS* 66, 1021-1038, doi:10.1007/s00018-009-8739-9 (2009).

56. D., M. C. et al. Crystal structure of human uracil-DNA glycosylase in complex with a protein inhibitor: protein mimicry of DNA. *Cell* 82, 701-708 (1995).

57. Caldecott, K. W. Single-strand break repair and genetic disease. *Nature reviews. Genetics* 9, 619-631, doi:10.1038/nrg2380 (2008).

58. Fukui, K. DNA mismatch repair in eukaryotes and bacteria. *Journal of nucleic acids* 2010, doi:10.4061/2010/260512 (2010).

59. Gasiunas, G., Barrangou, R., Horvath, P. & Siksnys, V. Cas9-crRNA ribonucleoprotein complex mediates specific DNA cleavage for adaptive immunity in bacteria. *Proceedings of the National Academy of Sciences* 109, E2579-E2586, doi:10.1073/pnas.1208507109 (2012).

60. Ran, F. A. et al. In vivo genome editing using *Staphylococcus aureus* Cas9. *Nature* 520, 186-191, doi:10.1038/nature14299 (2015).

61. Kuscu, C., Arslan, S., Singh, R., Thorpe, J. & Adli, M. Genome-wide analysis reveals characteristics of off-target sites bound by the Cas9 endonuclease. *Nature biotechnology* 32, 677-683, doi:10.1038/nbt.2916 (2014).

62. Wu, X. et al. Genome-wide binding of the CRISPR endonuclease Cas9 in mammalian cells. *Nature biotechnology* 32, 670-676, doi:10.1038/nbt.2889 (2014).

63. Beale, R. C. L. et al. Comparison of the Differential Context-dependence of DNA Deamination by APOBEC Enzymes: Correlation with Mutation Spectra in Vivo. *Journal of Molecular Biology* 337, 585-596, doi:10.1016/j.jmb.2004.01.046 (2004).

64. Kim, J., Basak, J. M. & Holtzman, D. M. The role of apolipoprotein E in Alzheimer's disease. *Neuron* 63, 287-303, doi:10.1016/j.neuron.2009.06.026 (2009).

65. Liu, C. C., Kanekiyo, T., Xu, H. & Bu, G. Apolipoprotein E and Alzheimer disease: risk, mechanisms and therapy. *Nature reviews. Neurology* 9, 106-118, doi:10.1038/nrneurol.2012.263 (2013).

66. Sjöblom, T. et al. The Consensus Coding Sequences of Human Breast and Colorectal Cancers. *Science* 314, 268-274, doi:10.1126/science.1133427 (2006).

67. Stephens, P. J. et al. The landscape of cancer genes and mutational processes in breast cancer. *Nature* 486, 400-404, doi:10.1038/nature11017 (2012).

68. Landrum, M. J. et al. ClinVar: public archive of interpretations of clinically relevant variants. *Nucleic Acids Research*, doi:10.1093/nar/gkv1222 (2015).

69. Slaymaker, I. M. et al. Rationally engineered Cas9 nucleases with improved specificity. *Science*, doi:10.1126/science.aad5227 (2015).

70. Davis, K. M., Pattanayak, V., Thompson, D. B., Zuris, J. A. & Liu, D. R. Small molecule-triggered Cas9 protein with improved genome-editing specificity. *Nature chemical biology* 11, 316-318, doi:10.1038/nchembio.1793 (2015).

71. Zuris, J. A. et al. Cationic lipid-mediated delivery of proteins enables efficient protein-based genome editing in vitro and in vivo. *Nature biotechnology* 33, 73-80, doi:10.1038/nbt.3081 (2015).

72. Kleinstiver, B. P. et al. Engineered CRISPR-Cas9 nucleases with altered PAM specificities. *Nature* 523, 481-485, doi:10.1038/nature14592 (2015).

73. Pattanayak, V. et al. High-throughput profiling of off-target DNA cleavage reveals RNA-programmed Cas9 nuclease specificity. *Nature Biotechnology* 31, 839-843, doi:10.1038/nbt.2673 (2013).

74. Shcherbakova, D. M. & Verkhusha, V. V. Near-infrared fluorescent proteins for multicolor in vivo imaging. *Nature Methods* 10, 751-754, doi:10.1038/nmeth.2521 (2013).

75. Ran, F. A. et al. Genome engineering using the CRISPR-Cas9 system. *Nat. Protocols* 8, 2281-2308, doi:10.1038/nprot.2013.143 (2013).

76. Jiang, F. et al. Structures of a CRISPR-Cas9 R-loop complex primed for DNA cleavage. *Science*, doi:10.1126/science.aad8282 (2016).

77. Tsai, S. Q. et al. Dimeric CRISPR RNA-guided FokI nucleases for highly specific genome editing. *Nat Biotech* 32, 569-576, doi:10.1038/nbt.2908 (2014).

78. Lieber, M. R., Ma, Y., Pannicke, U. & Schwarz, K. Mechanism and regulation of human non-homologous DNA end-joining. *Nat Rev Mol Cell Biol* 4, 712-720 (2003).

79. Heller, R. C. & Marians, K. J. Replisome assembly and the direct restart of stalled replication forks. *Nat Rev Mol Cell Biol* 7, 932-943 (2006).

80. Pluciennik, A. et al. PCNA function in the activation and strand direction of MutLa endonuclease in mismatch repair. *Proceedings of the National Academy of Sciences of the United States of America* 107, 16066-16071, doi:10.1073/pnas.1010662107 (2010).

81. Seripa, D. et al. The missing ApoE allele. *Annals of human genetics* 71, 496-500, doi:10.1111/j.1469-1809.2006.00344.x (2007).

82. Kleinstiver, B. P. et al. High-fidelity CRISPR-Cas9 nucleases with no detectable genome-wide off-target effects. *Nature* 529, 490-495, doi:10.1038/nature16526 (2016).

83. Richardson, C. D., Ray, G. J., DeWitt, M. A., Curie, G. L. & Corn, J. E. Enhancing homology-directed genome editing by catalytically active and inactive CRISPR-Cas9 using asymmetric donor DNA. *Nat Biotech* 34, 339-344, doi:10.1038/nbt.3481 (2016).

84. Simonelli, V., Narciso, L., Dogliotti, E. & Fortini, P. Base excision repair intermediates are mutagenic in mammalian cells. *Nucleic acids research* 33, 4404-4411, doi:10.1093/nar/gki749 (2005).

85. Barnes, D. E. & Lindahl, T. Repair and Genetic Consequences of Endogenous DNA Base Damage in Mammalian Cells. *Annual Review of Genetics* 38, 445-476, doi:doi:10.1146/annurev.genet.38.072902.092448 (2004).

Example 16: Improving DNA Specificity and Applicability of Base Editing Through Protein Engineering and Protein Delivery Base editing, a genome editing approach that enables the programmable conversion of one base pair into another without double-stranded DNA cleavage, excess stochastic insertions and deletions, or dependence on homology-directed repair was developed. The application of base editing is limited by off-target activity and reliance on intracellular DNA delivery. Here two advances are described that address these limitations. First, off-target base editing has been reduced by installing mutations into the third-generation base editor (BE3) to generate a high-fidelity base editor (HF-BE3). Next, BE3 and HF-BE3 are purified and delivered as ribonucleoprotein (RNP) complexes into mammalian cells, establishing DNA-free base editing. RNP delivery of BE3 confers higher specificity even than plasmid transfection of HF-BE3, while maintaining comparable on-target editing levels. Finally, these advances are applied to deliver BE3 RNPs into both zebrafish embryos and the inner ear of live mice to achieve specific, DNA-free base editing in vivo.

Introduction

Traditional genome editing agents introduce double-stranded DNA breaks (DSBs) as the first step of genome editing[1-4]. Cells respond to DSBs primarily through non-homologous end joining (NHEJ), resulting in stochastic insertions or deletions (indels) at the cleavage site[1,5]. To generate more precise changes in genomic DNA, homology-directed repair (HDR) can be used to replace the genomic DNA surrounding the cleavage site with that of an exogenously supplied DNA donor template[6-8]. Unfortunately, HDR is typically accompanied by an excess of indels resulting from competing NHEJ and is limited primarily to mitotic cells. In addition, most genome editing methods rely on delivery of exogenous plasmid or viral DNA into mammalian cells followed by intracellular expression of the agent[9-12]. These delivery methods result in continuous, uncontrolled Cas9 and sgRNA expression even after the on-target locus has been edited, increasing the opportunity for genome editing at off-target loci[1,13].

Base editing, a different approach to genome editing that enables the direct, programmable, targeted conversion of a C:G base pair to a T:A base pair, was recently described[3,14]. The third-generation base editor, BE3, contains in a single protein (i) a catalytically impaired Cas9 that opens a small single-stranded DNA bubble at a guide RNA-specified locus, (ii) a tethered single-strand-specific cytidine deaminase that converts C to U within a window of approximately five nucleotides in the single-stranded DNA bubble, (iii) a uracil glycosylase inhibitor (UGI) that inhibits base excision repair, thereby improving the efficiency and product selectivity of base editing, and (iv) nickase activity to manipulate cellular mismatch repair into replacing the G-containing DNA strand. The combination of these components enables efficient and permanent C to T (or G to A) conversion in mammalian cells with minimal indel formation. Since previously reported[14], other researchers have confirmed the ability of this strategy and related approaches to facilitate Cas9-directed C to T conversion in mammalian cells[15-17] and in plants[18].

Here, two advances that greatly improve the DNA specificity of base editing and that allow base editing in vitro and in vivo without supplying exogenous DNA, which has been associated with a risk of recombination with the host genome and cytotoxicity, are described[18,19]. First, a mutant form of BE3 incorporating mutations known to decrease the DNA affinity of Cas9[20] that reduces off-target editing events with only a modest decrease in on-target editing activity is engineered. Next, it is revealed that lipid-mediated delivery of base editor proteins complexed with guide RNA results in even larger specificity enhancements with no apparent reduction in on-target base editing compared to plasmid DNA delivery. Delivery of base editors as RNPs typically reduces off-target editing to below measurable levels, even for a notoriously promiscuous guide RNA that targets a highly repetitive genomic DNA sequence, in cultured human and mouse cells. These advances enable highly specific, DNA-free in vivo base editing in mice and zebrafish to be demonstrated.

Results

Engineering a High-Fidelity Base Editor

Cas9 nucleases and their associated fusion constructs have been shown to bind and cleave DNA at off-target genomic loci[21-24]. Joung and coworkers developed HF-Cas9, a high-fidelity SpCas9 variant containing four point mutations (N497A, R661A, Q695A, Q926A) that were designed to eliminate non-specific interactions between Cas9 and the phosphate backbone of the DNA target strand (FIG. 125A)[20] consistent with the previous abrogation of non-specific DNA interactions in TALENs that greatly increased their DNA cleavage specificity[25]. Since base editors operate on the non-target strand within the single-stranded DNA bubble created by Cas9[14] it can be hypothesized that introducing these four point mutations from HF-Cas9 into BE3 to generate "HF-BE3" might reduce off-target base editing without altering its base conversion capabilities (FIGS. 125A and 125C).

Plasmids encoding BE3 and HF-BE3 as His6-tagged proteins were overexpressed in E. coli and purified first by nickel affinity chromatography and then by cation exchange chromatography (FIGS. 126A-126B). Following extensive optimization of expression and purification conditions, BE3 and HF-BE3 protein can be routinely produced at a yield of ~2 mg per liter of culture media (FIGS. 126A-126C).

The purified base editor proteins were used to compare base editing efficiency and the width of the editing window of HF-BE3 and BE3 biochemically. In vitro C to U conversion efficiencies were measured in a synthetic dsDNA 79-mer with a protospacer comprised of TC repeats. The target dsDNA (250 nM) was incubated with BE3:sgRNA or HF-BE3:sgRNA (2 µM) for 30 min at 37° C. After incubation, the edited DNA was amplified using a uracil-tolerant polymerase and sequenced by high-throughput DNA sequencing (HTS). Comparable editing efficiencies and activity window widths were observed for HF-BE3 and BE3 in vitro (FIG. 125B). These findings indicate that introduction of the high-fidelity mutations into BE3 does not compromise inherent on-target base editing efficiency or change the width of the editing window of the resulting HF-BE3 protein in vitro.

HF-BE3 Enhances Editing Specificity Following DNA Transfection

Next, base editing efficiencies, specificities, and editing window widths of BE3 and HF-BE3 were compared in mammalian cells following plasmid DNA transfection. Four well-studied endogenous genomic loci (HEK293 site 3, FANCF, EMX1 and VEGFA site 2) were chosen to interrogate on- and off-target base editing in mammalian cells[14,24]. VEGFA site 2 is highly repetitive, containing 14 Cs out of 20 protospacer nucleotides, and is associated with notoriously high rate of known off-target genome editing[20,22,24,26]. This site was chosen to be included because it poses a formidable specificity challenge. In contrast with most nuclease-based genome editing applications, base editing relies on the precise location of the protospacer to place the target nucleotide within the editing window and usually little or no flexibility in the choice of guide RNA is available. Therefore, the development of base editors with enhanced specificities even for highly repetitive, promiscuous sgRNA targets is crucial[3, 14].

The on-target locus and known off-target loci were amplified by PCR and analyzed by HTS following plasmid transfection[24] with each of the four base editor:sgRNA pairs. On-target editing in HEK293T cells for these four endogenous genomic loci was slightly reduced by introduction of the HF mutations; editing averaged 29±5% with BE3, and 21±3% (mean±s.e.m. for n=3 biological replicates) for HF-BE3 (FIGS. 127A-127D, 128A).

For each of the three standard, non-repetitive target sites (HEK293 site 3, FANCF, and EMX1), the three most frequently modified off-target loci that contain a C within the editing window from the off-target loci previously reported to be modified from treatment with Cas9 and the same guide RNA were examined (Table 15)[24]. When cells were transfected with BE3 plasmid, C→T conversion across the nine most frequently modified Cas9 off-target loci for HEK293 site 3, FANCF, and EMX1 averaged 1.1±0.3% (FIGS. 127A-C; mean±s.d. for n=3 biological replicates). Installation of the HF mutations reduced the absolute level of mean off-target editing by 37-fold to 0.03±0.005%, with only one instance of measureable off-target C→T conversion (FIG. 127A; EMX1 $C_5$ at off-target 1).

To characterize HF-BE3 specificity on an extremely challenging site, BE3 and HF-BE3 off-target activity when targeting the highly repetitive VEGFA site 2 locus was compared. BE3 treatment lead to an average of 15±5% editing of cytosines located in the activity windows of the four tested off-target sites associated with this sgRNA (all average values quoted in this paragraph represent mean±s.d. for n 3 biological replicates). In contrast, HF-BE3 lead to a 3-fold reduction in absolute off-target editing (5.0±2.3%) at the same off-target sites (FIG. 127D). When compared to transfection of BE3, HF-BE3 significantly ($p<0.05$, two-tailed Student's t test) reduced off-target editing at 27 of the 57 cytosines located at off-target loci (Table 16), while HF-BE3 treatment lead to a significant reduction ($p<0.05$ two-tailed Student's t test) in on-target editing at only 3 of 16 the interrogated on-target cytosine residues.

TABLE 15

Protospacer and PAM sequences for the on- and off-target human genomic loci studied in this work. The off-target sites were chosen based on their GUIDE-Seq read count [45]. Cytosines within the editing window for a particular sgRNA are numbered. The PAM sequence is shown in bold. Protospacer bases in off-target loci that differ from their respective on-target loci have been underlined. For genomic sequences interrogated in murine samples, see FIG. 132E.

| Site | Sequence | SEQ ID NO | GUIDE-Seq count |
|---|---|---|---|
| EMX1 on-target | GAGTC$_5$C$_6$GAGCAGAAGAAGAAGGG | 480 | 4,521 |
| EMX1 off-target 1 | GAGTC$_5$<u>T</u>A<u>A</u>GCAGAAGAAGAAGAG | 481 | 1,445 |
| EMX1 off-target 2 | GAG<u>G</u>C$_5$C$_6$GAGCAGAAGAA<u>A</u>GACGG | 482 | 700 |
| EMX1 off-target 3 | GAGTC$_5$C$_6$<u>T</u>AGCAG<u>G</u>AGAAGAAGAG | 483 | 390 |
| HEK293 site 3 on-target | GGCC$_4$C$_5$AGACTGAGCACGTGATGG | 484 | 2,074 |
| HEK293 site 3 off-target 1 | <u>C</u>ACC$_4$C$_5$AGACTGAGCACGTG<u>C</u>TGG | 485 | 327 |
| HEK293 site 3 off-target 2 | G<u>A</u>CAC$_5$AGACTG<u>G</u>GCACGTGAGGG | 486 | 306 |
| HEK293 site 3 off-target 3 | <u>A</u>GCTC$_5$AGACTGAGCA<u>A</u>GTGAGGG | 487 | 136 |
| VEGFA site 2 on-target | GAC$_3$C$_4$C$_5$C$_6$C$_7$TC$_9$C$_{10}$ACCCCGCCTCCGG | 488 | 540 |
| VEGFA site 2 off-target 1 | <u>CT</u>AC$_4$C$_5$C$_6$C$_7$TC$_9$C$_{10}$ACCCCGCCTCCGG | 489 | 1,925 |
| VEGFA site 2 off-target 2 | <u>ATT</u>C$_4$C$_5$C$_6$C$_7$C$_8$C$_9$C$_{10}$ACCCCGCCTCAGG | 490 | 1,549 |
| VEGFA site 2 off-target 3 | <u>AC</u>AC$_4$C$_5$C$_6$C$_7$C$_8$C$_9$C$_{10}$ACCCCGCCTCAGG | 491 | 1,178 |
| VEGFA site 2 off-target 4 | <u>TG</u>C$_3$C$_4$C$_5$C$_6$C$_7$C$_8$C$_9$C$_{10}$ACCCC<u>A</u>CCTCTGG | 492 | 1,107 |
| FANCF on-target | GGAATC$_6$C$_7$C$_8$TTC$_{11}$TGCAGCACCTGG | 493 | 4,816 |
| FANCF off-target 1 | GGAAC$_5$C$_6$C$_7$C$_8$<u>G</u>TC$_{11}$TGCAGCACCAGG | 494 | 2,099 |
| FANCF off-target 2 | GGA<u>G</u>TC$_6$C$_7$C$_8$TC$_{10}$C$_{11}$<u>T</u>ACAGCACCAGG | 495 | 524 |
| FANCF off-target 3 | <u>A</u>GA<u>GG</u>C$_6$C$_7$C$_8$C$_9$TC$_{11}$TGCAGCACCAGG | 496 | 150 |

TABLE 16

P-values for differences in base editing under different treatment conditions at all loci evaluated in this study. p-values were calculated using the Student's two tailed t-test as described in the Materials and Methods. When the p-value indicated a significant difference (p < 0.05), the corresponding entry has been highlighted.
P values (Student's two-tailed t-test) for comparisons between listed treatments

| Locus and cytosine position | plasmid BE3 vs plasmid HF-BE3 | plasmid BE3 vs protein BE3 | plasmid BE3 vs protein HF-BE3 | plasmid BE3 vs control | plasmid HF-BE3 vs protein BE3 | plasmid HF-BE3 vs protein HF-BE3 | plasmid HF-BE3 vs control | protein BE3 vs protein HF-BE3 | protein BE3 vs control | protein HF-BE3 vs control |
|---|---|---|---|---|---|---|---|---|---|---|
| EMX1, C5 | 0.053 | 0.000 | 0.001 | 0.000 | 0.416 | 0.056 | 0.003 | 0.023 | 0.000 | 0.000 |
| EMX1, C6 | 0.065 | 0.000 | 0.000 | 0.000 | 0.445 | 0.023 | 0.004 | 0.001 | 0.000 | 0.003 |
| FANCF, C6 | 0.152 | 0.017 | 0.003 | 0.000 | 0.137 | 0.003 | 0.000 | 0.002 | 0.000 | 0.004 |
| FANCF, C7 | 0.591 | 0.554 | 0.007 | 0.000 | 0.137 | 0.003 | 0.000 | 0.002 | 0.000 | 0.004 |
| FANCF, C8 | 0.011 | 0.026 | 0.004 | 0.000 | 0.958 | 0.018 | 0.000 | 0.023 | 0.000 | 0.007 |
| FANCF, C11 | 0.524 | 0.948 | 0.019 | 0.001 | 0.363 | 0.010 | 0.000 | 0.010 | 0.000 | 0.021 |
| HEK site 3, C3 | 0.061 | 0.001 | 0.071 | 0.000 | 0.002 | 0.002 | 0.005 | 0.00199 | 0.001 | 0.003 |
| HEK site 3, C4 | 0.048 | 0.924 | 0.010 | 0.004 | 0.001 | 0.001 | 0.001 | 0.00004 | 0.000 | 0.001 |
| HEK site 3, C5 | 0.291 | 0.592 | 0.016 | 0.006 | 0.243 | 0.243 | 0.002 | 0.00022 | 0.000 | 0.001 |
| VEGFA site 2, C3 | 0.060 | 0.416 | 0.239 | 0.010 | 0.042 | 0.280 | 0.002 | 0.475 | 0.002 | 0.018 |
| VEGFA site 2, C4 | 0.036 | 0.191 | 0.047 | 0.004 | 0.032 | 0.803 | 0.002 | 0.066 | 0.000 | 0.005 |
| VEGFA site 2, C5 | 0.098 | 0.650 | 0.028 | 0.003 | 0.044 | 0.169 | 0.002 | 0.004 | 0.000 | 0.001 |
| VEGFA site 2, C6 | 0.452 | 0.781 | 0.118 | 0.004 | 0.165 | 0.239 | 0.002 | 0.013 | 0.000 | 0.001 |
| VEGFA site 2, C7 | 0.401 | 0.683 | 0.172 | 0.003 | 0.120 | 0.454 | 0.002 | 0.026 | 0.000 | 0.002 |
| VEGFA site 2, C9 | 0.225 | 0.308 | 0.254 | 0.004 | 0.504 | 0.828 | 0.004 | 0.624 | 0.000 | 0.002 |
| VEGFA site 2, C10 | 0.064 | 0.061 | 0.023 | 0.005 | 0.732 | 0.257 | 0.009 | 0.057 | 0.000 | 0.003 |
| EMX1, C5 off-target 1 | 0.003 | 0.003 | 0.002 | 0.002 | 0.119 | 0.036 | 0.035 | 0.269 | 0.255 | 0.643 |
| EMX1, C5 off-target 2 | 0.013 | 0.013 | 0.013 | 0.013 | 0.158 | 0.294 | 0.521 | 0.390 | 0.058 | 0.054 |
| EMX1, C6 off-target 2 | 0.024 | 0.024 | 0.024 | 0.024 | 0.285 | 0.560 | 0.954 | 0.420 | 0.103 | 0.306 |
| EMX1, C5 off-target 3 | 0.022 | 0.019 | 0.019 | 0.019 | 0.297 | 0.297 | 0.300 | >0.99999 | 0.882 | 0.815 |
| EMX1, C6 off-target 3 | 0.017 | 0.015 | 0.015 | 0.015 | 0.296 | 0.296 | 0.328 | >0.99999 | 0.051 | 0.025 |
| FANCF, C5 off-target 1 | 0.031 | 0.031 | 0.031 | 0.031 | 0.314 | 0.530 | 0.333 | 0.337 | 0.349 | 0.618 |
| FANCF, C6 off-target 1 | 0.016 | 0.016 | 0.016 | 0.016 | 0.347 | 0.786 | 0.930 | 0.338 | 0.344 | 0.678 |
| FANCF, C7 off-target 1 | 0.028 | 0.028 | 0.028 | 0.027 | 0.374 | 0.039 | 0.106 | 0.353 | 0.346 | 0.639 |

TABLE 16-continued

P-values for differences in base editing under different treatment conditions at all loci evaluated in this study. p-values were calculated using the Student's two tailed t-test as described in the Materials and Methods. When the p-value indicated a significant difference ($p < 0.05$), the corresponding entry has been highlighted.
P values (Student's two-tailed t-test) for comparisons between listed treatments

| Locus and cytosine position | plasmid BE3 vs plasmid HF-BE3 | plasmid BE3 vs protein BE3 | plasmid BE3 vs protein HF-BE3 | plasmid BE3 vs control | plasmid HF-BE3 vs protein BE3 | plasmid HF-BE3 vs protein HF-BE3 | plasmid HF-BE3 vs control | protein BE3 vs protein HF-BE3 | protein BE3 vs control | protein HF-BE3 vs control |
|---|---|---|---|---|---|---|---|---|---|---|
| FANCF, C8 off-target 1 | 0.014 | 0.014 | 0.014 | 0.014 | 0.341 | 0.932 | 0.685 | 0.343 | 0.318 | 0.605 |
| FANCF, C11 off-target 1 | 0.007 | 0.007 | 0.007 | 0.007 | 0.374 | 0.001 | 0.000 | >0.99999 | 0.475 | 0.016 |
| FANCF, C6 off-target 2 | 0.099 | 0.099 | 0.032 | 0.036 | 0.599 | 0.475 | 0.912 | 0.914 | 0.393 | 0.060 |
| FANCF, C7 off-target 2 | 0.080 | 0.080 | 0.027 | 0.030 | 0.898 | 0.638 | 0.819 | 0.539 | 0.859 | 0.530 |
| FANCF, C8 off-target 2 | 0.123 | 0.123 | 0.045 | 0.050 | 0.789 | 0.538 | 0.960 | 0.047 | 0.539 | 0.252 |
| FANCF, C10 off-target 2 | 0.093 | 0.093 | 0.029 | 0.033 | 0.630 | 0.509 | 0.847 | 0.768 | 0.670 | 0.482 |
| FANCF, C11 off-target 2 | 0.264 | 0.264 | 0.127 | 0.107 | 0.599 | 0.658 | 0.326 | >0.99999 | 0.047 | 0.345 |
| FANCF, C6 off-target 3 | 0.872 | 0.872 | 0.492 | 0.108 | 0.239 | 0.493 | 0.129 | 0.469 | 0.584 | 0.252 |
| FANCF, C7 off-target 3 | >0.99999 | >0.99999 | 0.859 | 0.016 | 0.537 | 0.866 | 0.116 | 0.572 | 0.272 | 0.595 |
| FANCF, C8 off-target 3 | 0.886 | 0.886 | 0.246 | 0.757 | >0.99999 | 0.001 | 0.648 | 0.495 | 0.780 | 0.650 |
| FANCF, C10 off-target 3 | 0.566 | 0.566 | 0.284 | 0.202 | 0.053 | 0.387 | 0.260 | 0.453 | 0.913 | 0.541 |
| FANCF, C11 off-target 3 | 0.422 | 0.422 | 0.145 | 0.145 | 0.495 | 0.230 | 0.230 | 0.658 | 0.658 | >0.99999 |
| HEK293 site 3, C3 off-target 1 | >0.99999 | 0.910 | 0.412 | 0.326 | 0.910 | 0.412 | 0.326 | 0.293 | 0.223 | 0.480 |
| HEK293 site 3, C4 off-target 1 | >0.99999 | 0.994 | 0.437 | 0.391 | 0.994 | 0.437 | 0.391 | 0.495 | 0.451 | 0.614 |
| HEK293 site 3, C5 off-target 1 | >0.99999 | 0.616 | 0.814 | 0.337 | 0.616 | 0.814 | 0.337 | 0.459 | 0.116 | 0.481 |
| HEK293 site 3, C3 off-target 2 | 0.285 | 0.473 | 0.100 | 0.473 | 0.141 | 0.735 | 0.141 | 0.038 | >0.99999 | 0.038 |
| HEK293 site 3, C5 off-target 2 | 0.375 | 0.294 | 0.177 | 0.294 | 0.687 | 0.428 | 0.687 | 0.064 | >0.99999 | 0.064 |
| HEK293 site 3, C9 off-target 2 | 0.053 | 0.624 | 0.374 | 0.624 | 0.554 | 0.154 | 0.554 | 0.872 | >0.99999 | 0.872 |
| HEK293 site 3, C3 off-target 3 | 0.067 | 0.116 | 0.768 | 0.435 | 0.519 | 0.230 | 0.561 | 0.349 | 0.768 | 0.643 |

TABLE 16-continued

P-values for differences in base editing under different treatment conditions at all loci evaluated in this study. p-values were calculated using the Student's two tailed t-test as described in the Materials and Methods. When the p-value indicated a significant difference (p < 0.05), the corresponding entry has been highlighted.
P values (Student's two-tailed t-test) for comparisons between listed treatments

| Locus and cytosine position | plasmid BE3 vs plasmid HF-BE3 | plasmid BE3 vs protein BE3 | plasmid BE3 vs protein HF-BE3 | plasmid BE3 vs control | plasmid HF-BE3 vs protein BE3 | plasmid HF-BE3 vs protein HF-BE3 | plasmid HF-BE3 vs control | protein BE3 vs protein HF-BE3 | protein BE3 vs control | protein HF-BE3 vs control |
|---|---|---|---|---|---|---|---|---|---|---|
| HEK293 site 3, C5 off-target 3 | 0.011 | 0.011 | 0.011 | 0.011 | 0.016 | 0.643 | 0.435 | 0.184 | 0.025 | 0.346 |
| HEK293 site 3, C9 off-target 3 | >0.99999 | 0.374 | 0.652 | 0.811 | 0.132 | 0.539 | 0.776 | 0.609 | 0.643 | 0.893 |
| VEGFA site 2, C4 off-target 1 | 0.101 | 0.015 | 0.014 | 0.012 | 0.041 | 0.032 | 0.025 | 0.117 | 0.012 | 0.001 |
| VEGFA site 2, C5 off-target 1 | 0.060 | 0.013 | 0.012 | 0.010 | 0.078 | 0.062 | 0.044 | 0.201 | 0.009 | 0.012 |
| VEGFA site 2, C6 off-target 1 | 0.019 | 0.005 | 0.005 | 0.004 | 0.080 | 0.062 | 0.045 | 0.087 | 0.002 | 0.012 |
| VEGFA site 2, C7 off-target 1 | 0.017 | 0.004 | 0.004 | 0.003 | 0.080 | 0.060 | 0.037 | 0.076 | 0.001 | 0.002 |
| VEGFA site 2, C9 off-target 1 | 0.230 | 0.088 | 0.037 | 0.011 | 0.667 | 0.256 | 0.051 | 0.134 | 0.004 | 0.007 |
| VEGFA site 2, C10 off-target 1 | 0.535 | 0.136 | 0.103 | 0.035 | 0.283 | 0.211 | 0.050 | 0.717 | 0.028 | 0.010 |
| VEGFA site 2, C4 off-target 2 | 0.038 | 0.004 | 0.003 | 0.003 | 0.087 | 0.051 | 0.048 | 0.063 | 0.048 | 0.134 |
| VEGFA site 2, C5 off-target 2 | 0.033 | 0.004 | 0.004 | 0.004 | 0.078 | 0.061 | 0.059 | 0.028 | 0.020 | 0.248 |
| VEGFA site 2, C6 off-target 2 | 0.026 | 0.005 | 0.005 | 0.004 | 0.051 | 0.038 | 0.038 | 0.043 | 0.038 | 0.783 |
| VEGFA site 2, C7 off-target 2 | 0.053 | 0.006 | 0.005 | 0.005 | 0.072 | 0.056 | 0.055 | 0.078 | 0.064 | 0.704 |
| VEGFA site 2, C8 off-target 2 | 0.071 | 0.006 | 0.006 | 0.006 | 0.079 | 0.065 | 0.065 | 0.118 | 0.107 | 0.703 |
| VEGFA site 2, C9 off-target 2 | 0.193 | 0.008 | 0.007 | 0.006 | 0.103 | 0.090 | 0.084 | 0.068 | 0.007 | 0.217 |
| VEGFA site 2, C10 off-target 2 | 0.063 | 0.003 | 0.003 | 0.002 | 0.116 | 0.107 | 0.090 | 0.545 | 0.016 | 0.346 |
| VEGFA site 2, C4 off-target 3 | 0.005 | 0.003 | 0.003 | 0.003 | 0.091 | 0.031 | 0.030 | 0.116 | 0.107 | 0.158 |

TABLE 16-continued

P-values for differences in base editing under different treatment conditions at all loci evaluated in this study. p-values were calculated using the Student's two tailed t-test as described in the Materials and Methods. When the p-value indicated a significant difference ($p < 0.05$), the corresponding entry has been highlighted.
P values (Student's two-tailed t-test) for comparisons between listed treatments

| Locus and cytosine position | plasmid BE3 vs plasmid HF-BE3 | plasmid BE3 vs protein BE3 | plasmid BE3 vs protein HF-BE3 | plasmid BE3 vs control | plasmid HF-BE3 vs protein BE3 | plasmid HF-BE3 vs protein HF-BE3 | plasmid HF-BE3 vs control | protein BE3 vs protein HF-BE3 | protein BE3 vs control | protein HF-BE3 vs control |
|---|---|---|---|---|---|---|---|---|---|---|
| VEGFA site 2, C5 off-target 3 | 0.011 | 0.007 | 0.005 | 0.005 | 0.211 | 0.048 | 0.042 | 0.220 | 0.177 | 0.001 |
| VEGFA site 2, C6 off-target 3 | 0.020 | 0.005 | 0.003 | 0.003 | 0.142 | 0.038 | 0.033 | 0.193 | 0.149 | 0.015 |
| VEGFA site 2, C7 off-target 3 | 0.045 | 0.006 | 0.003 | 0.003 | 0.101 | 0.035 | 0.030 | 0.093 | 0.060 | 0.083 |
| VEGFA site 2, C8 off-target 3 | 0.069 | 0.007 | 0.005 | 0.005 | 0.087 | 0.045 | 0.039 | 0.120 | 0.067 | 0.041 |
| VEGFA site 2, C9 off-target 3 | 0.093 | 0.006 | 0.005 | 0.005 | 0.041 | 0.032 | 0.028 | 0.396 | 0.195 | 0.005 |
| VEGFA site 2, C10 off-target 3 | 0.342 | 0.011 | 0.008 | 0.007 | 0.109 | 0.081 | 0.069 | 0.273 | 0.098 | 0.036 |
| VEGFA site 2, C3 off-target 4 | 0.001 | 0.001 | 0.001 | 0.001 | 0.374 | 0.374 | 0.230 | 0.271 | 0.358 | 0.633 |
| VEGFA site 2, C4 off-target 4 | 0.007 | 0.006 | 0.006 | 0.006 | 0.137 | 0.137 | 0.137 | 0.592 | 0.862 | 0.690 |
| VEGFA site 2, C5 off-target 4 | 0.007 | 0.007 | 0.007 | 0.007 | 0.026 | 0.017 | 0.018 | 0.461 | 0.655 | 0.279 |
| VEGFA site 2, C6 off-target 4 | 0.005 | 0.004 | 0.004 | 0.004 | 0.021 | 0.018 | 0.018 | 0.398 | 0.546 | 0.149 |
| VEGFA site 2, C7 off-target 4 | 0.007 | 0.006 | 0.006 | 0.006 | 0.051 | 0.048 | 0.050 | 0.373 | 0.720 | 0.029 |
| VEGFA site 2, C8 off-target 4 | 0.007 | 0.006 | 0.006 | 0.006 | 0.092 | 0.092 | 0.092 | 0.325 | 0.014 | 0.275 |
| VEGFA site 2, C9 off-target 4 | 0.016 | 0.007 | 0.007 | 0.007 | 0.150 | 0.150 | 0.150 | 0.502 | 1.000 | 0.615 |
| VEGFA site 2, C10 off-target 4 | 0.213 | 0.009 | 0.009 | 0.009 | 0.261 | 0.261 | 0.261 | 0.653 | 0.575 | 0.660 |

In addition to considering the differences between absolute editing at off-target loci, the on-target:off-target editing specificity ratio was also calculated by dividing the observed on-target efficiency by the off-target efficiency (FIGS. 129A-129B). This metric takes into account any reduction in on-target editing associated with installation of the HF-mutations, and is useful for applications sensitive to both the efficiency and specificity of base editing. Off-target editing by HF-BE3 was below the detection limit of high-throughput sequencing for several off-target loci. For these cases, a conservative off-target editing efficiency equal to the upper limit of detection was assumed (0.025% C→T conversion; see Methods). Based on this analysis, the average improvement in specificity ratio upon installation of the HF mutations across all 34 target cytosines examined herein was 19-fold, when plasmid delivery of the two constructs was performed. These results collectively establish that for non-repetitive sites (FIG. 129A) as well as a highly repetitive site (FIG. 129B), HF-BE3 results in substantially enhanced base editing specificity with only a modest reduction in on-target editing efficiency compared to BE3.

RNP Delivery of BE3 Enables DNA-Free Base Editing

Next, the ability of BE3 in DNA-free, RNP form to mediate base editing when directly delivered into cultured human cells was studied. It has recently been established that cationic lipid reagents can potently deliver negatively charged proteins or protein:nucleic acid complexes into mammalian cells including ribonucleoprotein (RNP) complexes and that RNP delivery can substantially reduce off-target genome editing[27-29]

The commercially available cationic lipid LIPO-FECTAMINE® 2000 transfection reagent was combined with either purified BE3 protein or HF-BE3 protein after pre-complexation with a guide RNA targeting the EMX1, HEK293 site 3, FANCF, or VEGFA site 2 locus and the resulting lipid:RNP complexes were incubated with HEK293T cells. After 72 h, genomic DNA was harvested and on-target and off-target base editing was analyzed by high-throughput DNA sequencing. As with all Cas9-based technologies, substantial variations were observed in editing efficiency at different genomic loci (FIGS. 127 and 130). To display trends associated with in on-target editing efficiency between different treatments, mean on-target base editing efficiencies were calculated at the four tested loci (FIG. 128A). Protein delivery of BE3 (200 nM) lead to on-target editing efficiencies comparable to those observed with plasmid transfection (26±4% vs. 29±5% respectively; mean±s.e.m. for n=3 biological replicates; FIG. 128A).

In contrast, protein delivery of HF-BE3 reduced on-target editing compared to protein delivery of BE3 at the four genomic loci studied (average editing efficiency of 13±3% vs. 26±4%, respectively; mean±s.e.m. for n=3 biological replicates; FIG. 128A). Since HF-BE3 and BE3 have comparable editing efficiencies in a test tube (FIG. 125B) and editing is only slightly reduced when HF-BE3 is expressed from plasmids in HEK293T cells (FIG. 127A-D), it is tempting to speculate that the decreased efficiency of editing from HF-BE3 protein delivery may be a result of decreased HF-BE3 stability in mammalian cells. Lower stability could be offset by continual expression from a plasmid, but not following one-time protein delivery. This observation is consistent with a recent report of reduced on-target indel formation with purified HF-Cas9 compared to purified Cas9 when nucleofected into CD34[+] hematopoietic stem and progenitor cells[30]. While this work was in review, Kim et al demonstrated RNP delivery of BE3 into mouse embryos using electroporation[31]. To the best of the inventors' knowledge, the present approach is the first DNA-free technique capable of generating precise changes to individual nucleotides in mammalian cells without electroporation, which has limited in vivo therapeutic relevance.

RNP Delivery of Base Editors Greatly Enhances DNA Specificity

Importantly, while RNP delivery of BE3 and HF-BE3 led to substantial on-target base editing, no instances of measurable base editing (<0.025%) were observed at any of the nine tested off-target loci associated with EMX1, FANCF and HEK293 site 3, (FIGS. 130A-130C). In contrast, plasmid delivery of BE3 lead to an average of 1.1±0.3% (mean±s.d. for n=3 biological replicates) off-editing across all sequenced cytosines within the base editing activity window, and detectable off-target editing at 11 of 16 off-target cytosines located at these nine off-target loci (FIGS. 127A-127D). At off-target loci of the three non-repetitive loci tested, BE3 protein delivery lead to a 26-fold higher average specificity ratio than that of plasmid delivery (FIG. 127A). These results reveal that RNP delivery of base editors dramatically increases the DNA specificity of base editing.

Protein delivery of either BE3 or HF-BE3 also resulted in greatly improved base editing specificity at the highly promiscuous VEGFA site 2 locus compared to plasmid delivery of either BE3 or HF-BE3 (compare FIGS. 127 and 130; see Table 16). Absolute frequencies of base editing at the off-target loci associated with this site were reduced upon protein delivery at least 10-fold for both BE3 (plasmid delivery: 15±4% off-target editing; protein delivery: 1.3±0.4% off-target editing; all values in this paragraph represent mean±s.d. for n=3 biological replicates) and HF-BE3 (plasmid delivery: 5±2% off-target editing; protein delivery: 0.5±0.1% off-target editing). Across all four studied loci, base editing specificity ratios for on-target:off-target editing increased an average of 66-fold for protein delivery of BE3 compared with plasmid delivery of BE3 (FIG. 129). Collectively, these results reveal that for both repetitive and non-repetitive target sites, RNP versus DNA delivery is a stronger determinant of base editing specificity than the presence or absence of the high-fidelity Cas9 mutations.

Neither introduction of the HF mutations nor delivery method substantially altered the low indel rates associated with base editing. Indel frequencies at all on-target loci across all treatment conditions in this study remained low (typically ≤5%; FIG. 131A), and the editing:indel ratio remained higher in all cases tested (typically ≥10-fold; FIG. 131B) than in previous studies using optimized HDR protocols[30,32,33]. For non-repetitive sgRNAs, very few indels were observed at off-target loci (FIG. 131C), although it is noted that plasmid delivery of BE3 generated up to 5% indels for off-target loci associated with VEGFA site 2 (FIG. 131C).

Taken together, these results establish that protein delivery of base editors maintains on-target base editing efficiency and greatly enhances editing specificity relative to delivery of plasmid DNA.

RNP Delivery Decouples On- and Off-Target Editing

Given the striking enhancement of base editing specificity associated with protein delivery of BE3, it was investigated if this improvement was a result of a reduction in the total quantity of active genome editing agent delivered into the cell. Using the sgRNA targeting EMX1, a dose response study for plasmid (FIG. 128B) and protein delivery (FIG. 128C) was performed. To maximize transfection efficiency between treatment conditions, the volume of LIPO-FECTAMINE® 2000 transfection reagent was 1.5 µL for all tests, and the base editor protein:sgRNA molar ratio was maintained at 1:1.1 for protein delivery. For plasmid delivery, a mass ratio of sgRNA plasmid:BE3 plasmid of 1:3 (molar ratio ~1:1) and 1.5 µL of LIPOFECTAMINE® 2000 transfection reagent were used. Off-target base editing was observed under all conditions tested for plasmid delivery (FIG. 128B), but virtually no off-target editing under all protein delivery conditions tested (FIG. 128C).

Linear regression analysis was performed to assess the relationship between on- and off-target editing for plasmid and protein delivery. For plasmid delivery, off-target editing was closely associated with on-target editing rates ($R^2$=0.95, p=0.0012 for non-zero slope, F-test), whereas there was no significant association between off-target and on-target editing using protein delivery ($R^2=0.078$, $p=0.59$ for non-zero slope, F-test).

These data indicate that protein delivery of base editors offers an inherent specificity advantage that is independent of dosage. Together with the previous observations[29,34], these findings support a model in which the higher DNA specificity of base editing from protein delivery compared to DNA delivery arises from the ability of protein delivery to avoid extended exposure of the genome to base editors, thereby minimizing the opportunity of base editors to process off-target loci after on-target loci have already been modified.

DNA-Free Base Editing in Zebrafish and Mice

The above observations suggested the promise of protein delivery of BE3 to maintain on-target base editing while eliminating detectable off-target base editing. It was therefore tested whether protein delivery of BE3 could be used to generate specific point mutations in zebrafish by injecting BE3:sgRNA complexes targeting the tyrosinase locus into fertilized zebrafish embryos. Genomic DNA was harvested from the resultant zebrafish larvae 4 days post-injection and measured base editing and indel frequencies by high-throughput sequencing (FIG. 132A). Two of the three BE3:sgRNA complexes tested induced substantial point mutations in vivo (TYR1: $C_3 \rightarrow T_3$ 5.3±1.8%, TYR2: $C_4 \rightarrow T_4$ 4.3±2.1%; mean±s.d. of n=3 injected embryos; FIG. 132A). Sequences of zebrafish loci are listed in Table 17.

TABLE 17

Number of HTS reads that align to the reference sequence and pass the quality filters described in Materials and Methods.

| Sample Description | Replicate 1 | Replicate 2 | Replicate 3 | Amplicon |
|---|---|---|---|---|
| HEK cell samples | | | | |
| Protein, BE3 | 237256 | 295609 | 159391 | VEGFA On Target |
| Protein, HF-BE3 | 383480 | 389874 | 383467 | VEGFA On Target |
| Plasmid, BE3 | 315213 | 280891 | 335668 | VEGFA On Target |
| Plasmid, HF-BE3 | 196323 | 251965 | 369201 | VEGFA On Target |
| Control | 390748 | 395523 | 353614 | VEGFA On Target |
| Protein, BE3 | 19280 | 26472 | 24799 | FANCF Off Target Site # 1 |
| Protein, HF-BE3 | 36383 | 30007 | 39193 | FANCF Off Target Site # 1 |
| Plasmid, BE3 | 35580 | 29557 | 22243 | FANCF Off Target Site # 1 |
| Plasmid, HF-BE3 | 40371 | 27187 | 28248 | FANCF Off Target Site # 1 |
| Control | 35106 | 37274 | 34939 | FANCF Off Target Site # 1 |
| Protein, BE3 | 82978 | 124689 | 83840 | VEGFA Off Target Site # 1 |
| Protein, HF-BE3 | 142404 | 140482 | 142220 | VEGFA Off Target Site # 1 |
| Plasmid, BE3 | 112027 | 117071 | 100894 | VEGFA Off Target Site # 1 |
| Plasmid, HF-BE3 | 114187 | 98876 | 122553 | VEGFA Off Target Site # 1 |
| Control | 76854 | 90547 | 89271 | VEGFA Off Target Site # 1 |
| Protein, BE3 | 14514 | 25515 | 19325 | VEGFA Off Target Site # 2 |
| Protein, HF-BE3 | 24678 | 24363 | 25312 | VEGFA Off Target Site # 2 |
| Plasmid, BE3 | 16945 | 19918 | 10225 | VEGFA Off Target Site # 2 |
| Plasmid, HF-BE3 | 12200 | 14769 | 17797 | VEGFA Off Target Site # 2 |
| Control | 8739 | 13648 | 7818 | VEGFA Off Target Site # 2 |
| Protein, BE3 | 17924 | 111693 | 173909 | VEGFA Off Target Site # 3 |
| Protein, HF-BE3 | 243899 | 300503 | 276139 | VEGFA Off Target Site # 3 |
| Plasmid, BE3 | 208476 | 291370 | 155430 | VEGFA Off Target Site # 3 |
| Plasmid, HF-BE3 | 117174 | 154033 | 199152 | VEGFA Off Target Site # 3 |
| Control | 119263 | 170436 | 121686 | VEGFA Off Target Site # 3 |
| Protein, BE3 | 237799 | 262947 | 185371 | VEGFA Off Target Site # 4 |
| Protein, HF-BE3 | 313253 | 233699 | 244922 | VEGFA Off Target Site # 4 |
| Plasmid, BE3 | 243094 | 230316 | 234421 | VEGFA Off Target Site # 4 |
| Plasmid, HF-BE3 | 170958 | 160091 | 140693 | VEGFA Off Target Site # 4 |
| Control | 158691 | 148720 | 137270 | VEGFA Off Target Site # 4 |
| Protein, BE3 | 28684 | 28237 | 43315 | HEK3 On Target |
| Protein, HF-BE3 | 49300 | 42576 | 57690 | HEK3 On Target |
| Plasmid, BE3 | 55008 | 55813 | 54310 | HEK3 On Target |
| Plasmid, HF-BE3 | 55199 | 11384 | 7659 | HEK3 On Target |
| Control | 63741 | 42878 | 48524 | HEK3 On Target |
| Protein, BE3 | 104822 | 181792 | 161090 | HEK3 Off Target Site # 1 |
| Protein, HF-BE3 | 204580 | 175561 | 177303 | HEK3 Off Target Site # 1 |
| Plasmid, BE3 | 178584 | 152264 | 206863 | HEK3 Off Target Site # 1 |
| Plasmid, HF-BE3 | 191297 | 138425 | 160789 | HEK3 Off Target Site # 1 |
| Control | 190303 | 190061 | 190516 | HEK3 Off Target Site # 1 |
| Protein, BE3 | 146089 | 95113 | 135015 | HEK3 Off Target Site # 2 |
| Protein, HF-BE3 | 155947 | 136541 | 157991 | HEK3 Off Target Site # 2 |
| Plasmid, BE3 | 150036 | 128438 | 158905 | HEK3 Off Target Site # 2 |
| Plasmid, HF-BE3 | 371077 | 123642 | 142562 | HEK3 Off Target Site # 2 |
| Control | 130322 | 134545 | 141833 | HEK3 Off Target Site # 2 |
| Protein, BE3 | 145058 | 175338 | 161837 | HEK3 Off Target Site # 3 |
| Protein, HF-BE3 | 212337 | 178993 | 179887 | HEK3 Off Target Site # 3 |
| Plasmid, BE3 | 186452 | 166500 | 80441 | HEK3 Off Target Site # 3 |
| Plasmid, HF-BE3 | 163732 | 118453 | 134719 | HEK3 Off Target Site # 3 |
| Control | 131461 | 134470 | 155608 | HEK3 Off Target Site # 3 |
| Protein, BE3 | 41986 | 61678 | 67890 | FANCF On Target |
| Protein, HF-BE3 | 41057 | 55850 | 86411 | FANCF On Target |
| Plasmid, BE3 | 39114 | 48575 | 70074 | FANCF On Target |
| Plasmid, HF-BE3 | 41617 | 55638 | 75718 | FANCF On Target |
| Control | 68852 | 59422 | 81265 | FANCF On Target |
| Protein, BE3 | 113462 | 80529 | 191344 | FANCF Off Target Site # 1 |
| Protein, HF-BE3 | 202662 | 233981 | 203024 | FANCF Off Target Site # 1 |
| Plasmid, BE3 | 208912 | 202044 | 107234 | FANCF Off Target Site # 1 |
| Plasmid, HF-BE3 | 86494 | 113989 | 86807 | FANCF Off Target Site # 1 |
| Control | 92255 | 72386 | 56661 | FANCF Off Target Site # 1 |
| Protein, BE3 | 96271 | 117442 | 84374 | FANCF Off Target Site # 2 |
| Protein, HF-BE3 | 105624 | 102312 | 105343 | FANCF Off Target Site # 2 |
| Plasmid, BE3 | 101002 | 98747 | 70052 | FANCF Off Target Site # 2 |

TABLE 17-continued

Number of HTS reads that align to the reference sequence and pass the quality filters described in Materials and Methods.

| | | | | |
|---|---|---|---|---|
| Plasmid, HF-BE3 | 308966 | 69787 | 83184 | FANCF Off Target Site # 2 |
| Control | 99986 | 100344 | 100659 | FANCF Off Target Site # 2 |
| Protein, BE3 | 25524 | 182451 | 65388 | FANCF Off Target Site # 3 |
| Protein, HF-BE3 | 71858 | 75553 | 71785 | FANCF Off Target Site # 3 |
| Plasmid, BE3 | 60980 | 57360 | 78169 | FANCF Off Target Site # 3 |
| Plasmid, HF-BE3 | 68316 | 34659 | 85718 | FANCF Off Target Site # 3 |
| Control | 49685 | 57388 | 60418 | FANCF Off Target Site # 3 |
| Protein, BE3 | 46981 | 90793 | 79439 | EMX1 On Target |
| Protein, HF-BE3 | 58629 | 71186 | 61575 | EMX1 On Target |
| Plasmid, BE3 | 70817 | 82736 | 75706 | EMX1 On Target |
| Plasmid, HF-BE3 | 77038 | 71123 | 78511 | EMX1 On Target |
| Control | 62183 | 48574 | 68439 | EMX1 On Target |
| Protein, BE3 | 165905 | 257565 | 142888 | EMX 1 Off Target Site # 1 |
| Protein, HF-BE3 | 148339 | 151300 | 130712 | EMX 1 Off Target Site # 1 |
| Plasmid, BE3 | 101950 | 103226 | 203004 | EMX 1 Off Target Site # 1 |
| Plasmid, HF-BE3 | 167969 | 175193 | 97010 | EMX 1 Off Target Site # 1 |
| Control | 101476 | 150435 | 102327 | EMX 1 Off Target Site # 1 |
| Protein, BE3 | 136738 | 213438 | 118711 | EMX 1 Off Target Site # 2 |
| Protein, HF-BE3 | 123413 | 126114 | 109375 | EMX 1 Off Target Site # 2 |
| Plasmid, BE3 | 85576 | 86600 | 169592 | EMX 1 Off Target Site # 2 |
| Plasmid, HF-BE3 | 140317 | 145738 | 137050 | EMX 1 Off Target Site # 2 |
| Control | 84818 | 125139 | 85454 | EMX 1 Off Target Site # 2 |
| Protein, BE3 | 11940 | 36593 | 24946 | EMX1 Off Target Site # 3 |
| Protein, HF-BE3 | 26762 | 31566 | 36377 | EMX1 Off Target Site # 3 |
| Plasmid, BE3 | 32420 | 21547 | 14659 | EMX1 Off Target Site # 3 |
| Plasmid, HF-BE3 | 31427 | 16592 | 17385 | EMX1 Off Target Site # 3 |
| Control | 17385 | 28128 | 32717 | EMX1 Off Target Site # 3 |
| Murine Samples from NIH 3T3 cell treatment | | | | |
| Plasmid, BE3 | 16641 | 102216 | 46361 | On Target VEGFA (Mus) |
| Plasmid, HF-BE3 | 89330 | 126545 | 100993 | On Target VEGFA (Mus) |
| Protein, BE3 | 88998 | 81697 | 51124 | On Target VEGFA (Mus) |
| Protein, HF-BE3 | 128218 | 29193 | 131515 | On Target VEGFA (Mus) |
| Control | 18767 | 38866 | 58985 | On Target VEGFA (Mus) |
| Plasmid, BE3 | 174782 | 167504 | 182565 | CFD Off Target 1 |
| Plasmid, HF-BE3 | 167120 | 182520 | 192389 | CFD Off Target 1 |
| Protein, BE3 | 230569 | 212605 | 138144 | CFD Off Target 1 |
| Protein, HF-BE3 | 228668 | 211457 | 183370 | CFD Off Target 1 |
| Control | 171738 | 191117 | 20879 | CFD Off Target 1 |
| Plasmid, BE3 | 206475 | 227332 | 206089 | CFD Off Target 2 |
| Plasmid, HF-BE3 | 213809 | 203028 | 199078 | CFD Off Target 2 |
| Protein, BE3 | 215995 | 275754 | 249969 | CFD Off Target 2 |
| Protein, HF-BE3 | 250918 | 272063 | 241059 | CFD Off Target 2 |
| Control | 193760 | 175959 | 246963 | CFD Off Target 2 |
| Plasmid, BE3 | 60388 | 126278 | 7328 | CFD Off Target 3 |
| Plasmid, HF-BE3 | 89045 | 128508 | 5178 | CFD Off Target 3 |
| Protein, BE3 | 167195 | 330046 | 11163 | CFD Off Target 3 |
| Protein, HF-BE3 | 82120 | 309352 | 10393 | CFD Off Target 3 |
| Control | 83204 | 176939 | 5661 | CFD Off Target 3 |
| Plasmid, BE3 | 192846 | 113709 | 171078 | CFD Off Target 4 |
| Plasmid, HF-BE3 | 205601 | 151434 | 188943 | CFD Off Target 4 |
| Protein, BE3 | 218194 | 181993 | 208398 | CFD Off Target 4 |
| Protein, HF-BE3 | 211966 | 148976 | 186838 | CFD Off Target 4 |
| Control | 183933 | 130318 | 197476 | CFD Off Target 4 |
| Mouse Cochlea Samples | | | | |
| Stria vascularies | 37889 | 205706 | 62091 | On Target (VEGFA) |
| Organ of Corti | 148447 | 175004 | 29075 | On Target (VEGFA) |
| Modiolus | 182806 | 181382 | 61269 | On Target (VEGFA) |
| Uninjected control | 228222 | 241979 | 272759 | On Target (VEGFA) |
| Stria vascularies | 44457 | 244487 | 244646 | CFD Off Target 1 |
| Organ of Corti | 136335 | 118318 | 34747 | CFD Off Target 1 |
| Modiolus | 67176 | 209543 | 68699 | CFD Off Target 1 |
| Uninjected control | 343100 | 342717 | 379015 | CFD Off Target 1 |
| Stria vascularies | 72962 | 319883 | 265793 | CFD Off Target 2 |
| Organ of Corti | 198456 | 131430 | 60530 | CFD Off Target 2 |
| Modiolus | 92014 | 251509 | 81413 | CFD Off Target 2 |
| Uninjected control | 399138 | 345965 | 483920 | CFD Off Target 2 |
| Stria vascularies | 8325 | 80322 | 142556 | CFD Off Target 3 |
| Organ of Corti | 81014 | 45976 | 1810 | CFD Off Target 3 |
| Modiolus | 9928 | 75555 | 11341 | CFD Off Target 3 |
| Uninjected control | 399138 | 345965 | 483920 | CFD Off Target 3 |
| Stria vascularies | 232194 | 397770 | 554054 | CFD Off Target 4 |
| Organ of Corti | 313472 | 285302 | 176872 | CFD Off Target 4 |
| Modiolus | 230105 | 371399 | 258142 | CFD Off Target 4 |
| Uninjected control | 524503 | 637946 | 624709 | CFD Off Target 4 |

| Zebrafish samples | | | | |
|---|---|---|---|---|
| | 1 | 2 | 3 | Amplicon |
| Treated zebrafish | 72355 | 49498 | 81061 | TYR 1 |
| Scrambled sgRNA | 107919 | 98502 | 92429 | TYR 1 |
| Treated zebrafish | 51434 | 48014 | 41547 | TYR 2 |
| Scrambled sgRNA | 61466 | 62374 | 66765 | TYR 2 |
| Treated zebrafish | 6487 | 57247 | 75883 | TYR 3 |
| Scrambled sgRNA | 64596 | 71234 | 75624 | TYR 3 |

Mouse Cochlea Samples - treated with unrealated sgRNA

| Sample | | | | |
|---|---|---|---|---|
| Stria | Cortii | Modiolus | | Amplicon |
| 537459 | 249767 | 389274 | | On Target (VEGFA) |

Finally, these developments were applied to achieve DNA-free, high-specificity base editing in mice. To maximize the likelihood of observing on- and off-target base editing in vivo, the highly repetitive sgRNA targeting VEGFA site 2 was used; conveniently, the murine and human genomes are identical at this target site.

Using cultured murine NIH/3T3 cells, it was confirmed that BE3 protein delivery yielded efficient on-target base editing at this locus 34±11% (FIG. 133A; all editing percentages in this paragraph represent mean±s.d. for n=3 biological replicates). The Cutting Frequency Determinant (CFD) algorithm[29,34] was used to predict off-target loci in the mouse genome associated with the VEGFA site 2 sgRNA (Table 18). Using cultured NIH/3T3 cells, it was confirmed that two of the top four predicted off-target loci are indeed modified by plasmid delivery of BE3 in cultured murine cells (CFD off-target locus 1, 9±5% editing; and CFD off-target locus 4, 3±2% editing; FIG. 133B-133E). Consistent with the results from human cells, protein delivery of BE3 reduced off-target editing to levels similar to that of negative controls (FIGS. 133C and 133E). The mean base editing specificity ratio for CFD off-target loci 1 and 4 increased from 28±13 for plasmid delivery of BE3 to ≥780±300 for protein delivery of BE3 (values represent mean±s.e.m.; n=3 biological replicates).

TABLE 18

Protospacer and PAM sequences for the predicted off-target loci in the mouse genome associated with the VEGFA site 2 sgRNA. CFD scores [46] were calculated using CRISPOR [47].
Positions in the off-target protospacers that differ from the on-target sequence are underlined.

| Site | Sequence | SEQ ID NO | CFD score | Description of locus |
|---|---|---|---|---|
| On-target | GACCCCTCCACCCCGCCTCCGG | 497 | | VEGFA site 2 |
| Off-target 1 | TCCCCCCTCCACCCCACCTCCGG | 498 | 0.7857 | intergenic:mmu-mir-21c-Nrp1/Mir1903 |
| Off-target 2 | TGCCCACCTCACCCCGCCTCTGG | 499 | 0.65 | intron:Vipr1 |
| Off-target 3 | GCCCCTCCCAACCCCACCTCTGG | 500 | 0.6323 | intron:Nos1ap |
| Off-target 4 | CACCCCCCTCACCCCGCCTCAGG | 501 | 0.625 | intergenic:Unc5b-mmu-mir-6408 |

To establish DNA-free base editing in mice, BE3:sgRNA complexes were combined with LIPOFECTAMINE® 2000 transfection reagent (FIG. 132B) and intracochlear injections were performed into mouse pups at P1-P2. Injected cochlear tissues were harvested 3-4 days post-injection and micro-dissected into 5-7 samples per cochlear region. Control cochlea from uninjected mice were harvested simultaneously. Genomic DNA was extracted from the harvested tissue, amplified by qPCR to late-exponential phase, and subjected to high-throughput DNA sequencing to measure C→T conversion. Although it is impossible to quantitate base editing efficiency among treated cells because it is not possible to retrieve DNA exclusively from cells exposed to base editor protein, unambiguous base editing was observed from tissue in three regions of the cochlea: the basal end of the organ of Corti, the stria vascularis and the modiolus (FIGS. 132C-132D). No significant indel formation was detected in treated tissue samples (<0.1% indels; FIG. 134B).

The percentage of cochlear cells containing target C→T conversion (FIG. 132C) was significantly lower than that observed in treated NIH/3T3 cells in culture (FIG. 133A), consistent with the highly localized nature of lipid-based protein delivery and the inability to isolate DNA exclusively from cells exposed to base editor. Nonetheless, local delivery offers key advantages for accessible applications, including control over which cell types are edited, and ease of preparation and administration.

Finally, off-target editing following intracochlear injection of BE3:sgRNA:lipid complexes was analyzed. Analysis of all four predicted off-target loci, including the confirmed off-target sites CFD locus 1 and CFD locus 4, in genomic DNA from the cochlear tissue of mice injected with the BE3:VEGFA site 2 sgRNA:lipid complex revealed no detectable C→T conversion or indel formation above that observed in untreated controls samples for any of the off-target loci tested (FIG. 134A).

Together, these in vivo base editing results establish a virus-free, DNA-free strategy for the precise conversion of individual nucleotides in the genomic DNA of animals with high DNA sequence specificity.

DISCUSSION

Figure 132:
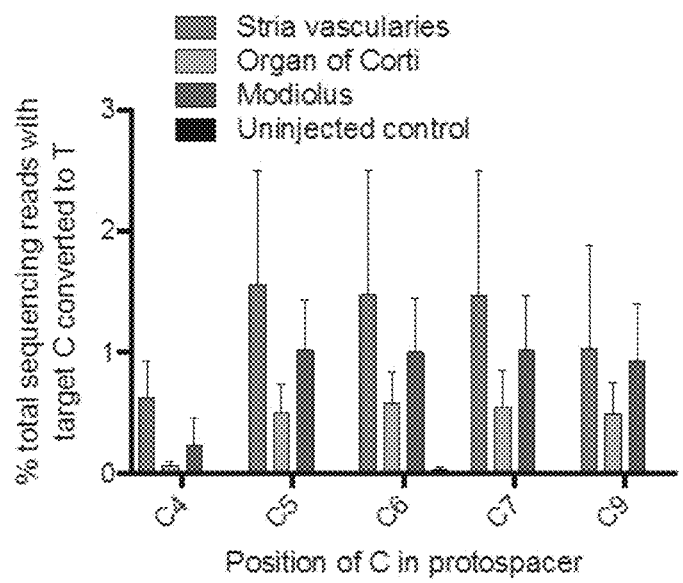

The strategies developed and implemented in this study expand the utility and applicability of base editing by removing or reducing off-target base editing and establishing a DNA-free delivery method that supports in vivo base editing. Protein delivery improves base editing specificity in human and murine cells compared with plasmid delivery of the same constructs (FIGS. 137, 130, and 133), and enables specific base editing in zebrafish and in the mouse cochlea (FIG. 132).

A high-fidelity base editor was generated by installing into BE3 mutations known to enhance the DNA specificity of Cas9[20]. The installation of these mutations into Cas9 was reported to result in undetectable indel formation at off target loci associated with non-repetitive sgRNAs, including the EMX1 locus interrogated here (FIG. 127A)[20]. The specificity enhancements observed in HF-BE3, while substantial, were more modest; HF-BE3 exhibited detectable off-target base editing at both repetitive and non-repetitive loci when delivered as plasmid DNA into mammalian cells (FIGS. 127A, 127D, 133C, and 133E). It is tempting to speculate that this specificity enhancement difference may arise from the fact that base editing, unlike Cas9-mediated indel formation, does not require DNA cleavage but only necessitates DNA-binding and R-loop formation[14], and some of the enhanced specificity of HF-Cas9 may arise from impaired DNA cleavage at already-bound off-target loci.

In a second attempt to reduce off-target base editing, it was demonstrated that RNP delivery of base editors leads to decoupling of on- and off-target editing (FIG. 128B-128C). RNP delivery ablated off-target editing at non-repetitive sites while maintaining on-target editing comparable to plasmid delivery (FIGS. 130A-130C and 128A), and greatly reduced off-target editing even at the highly repetitive VEGFA site 2 (FIG. 130D). RNP delivery of base editors may be especially useful for in vivo editing applications in which cellular dosage is typically difficult to control or characterize.

RNP delivery of Cas9 coupled with delivery of a donor DNA template has previously been used to perform HDR-based genome editing in mammalian cells. These approaches, however, remain limited by low efficiency, cell-state dependence, and indel formation efficiencies typically exceeding those of desired HDR outcomes, especially for point mutation correction[29,30,32,35] DNA-free base editing, in contrast, generates a substantial excess of edited product relative to stochastic indels both in vivo and in cells (FIGS. 132A, 134A, and 134B). To the best of the inventors' knowledge, RNP delivery of base editors represents the first strategy for generating specific and precise modifications to genomic DNA without requiring exogenous DNA.

Methods

Cloning of Plasmids

The plasmids in this study were generated by USER cloning. Phusion U Hot Start polymerase (Thermo Fisher) was used to install point mutations and construct protein expression plasmids from previously reported constructs[36]. Protein sequences are listed in the Supplementary Information, and plasmids for expression of BE3 and HF-BE3 are available from Addgene.

Expression and Purification of BE3 and HF-BE3

BL21 Star (DE3)-competent *E. coli* cells were transformed with plasmids encoding the bacterial codon optimized base editors with a His6 N-terminal purification tag. A single colony was grown overnight in Luria-Bertani (LB) broth containing 50 μg mL$^{-1}$ kanamycin at 37° C. The cells were diluted 1:200 into 2 L of the same media and grown at 37° C. until $OD_{600}$=0.70-0.75. The cultures were incubated on ice for 60 min and protein expression was induced with 0.5 mM isopropyl-β-D-1-thiogalactopyranoside (IPTG, GoldBio). Expression was sustained for 14-16 h with shaking at 18° C. The subsequent purification steps were carried out at 4° C. Cells were collected by centrifugation at 6,000 g for 20 min and resuspended in cell collection buffer (100 mM tris(hydroxymethyl)-aminomethane (Tris)-HCl, pH 8.0, 1 M NaCl, 20% glycerol, 5 mM tris(2-carboxyethyl)phosphine (TCEP; GoldBio), 0.4 mM phenylmethane sulfonyl fluoride (PMSF; Sigma Aldrich) and 1 cOmplete, EDTA-free protease inhibitor pellet (Roche) per 50 mL buffer used). Cells were lysed by sonication (6 min total, 3 s on, 3 s off) and the lysate cleared by centrifugation at 25,000 g (20 min).

The cleared lysate was incubated with His-Pur nickel nitriloacetic acid (nickel-NTA) resin (1 mL resin per litre of culture, Thermo Fisher) with rotation at 4° C. for 60-90 min. The resin was washed with 20 column volumes of cell collection buffer before bound protein was eluted with elution buffer ((100 mM tris(hydroxymethyl)-aminomethane (Tris)-HCl, pH 8.0, 0.5 M NaCl, 20% glycerol, 5 mM tris (2-carboxyethyl) phosphine (TCEP; GoldBio), 200 mM imidazole). The resulting protein fraction was further purified on a 5 mL Hi-Trap HP SP (GE Healthcare) cation exchange column using an Akta Pure FPLC. Protein-containing fractions were concentrated using a column with a 100,000 kDa cutoff (Millipore) centrifuged at 3,000 g and the concentrated solution was sterile filtered through an 0.22 μm PVDF membrane (Millipore).

After sterile filtration, proteins were quantified with Reducing Agent Compatible Bicinchoninic acid (BCA) assay (Pierce Biotechnology), snap-frozen in liquid nitrogen and stored in aliquots at −80° C. Sequences of expressed proteins are listed in Supplementary Note 2.

In Vitro Transcription of sgRNA

Linear DNA fragments containing the T7 RNA polymerase promoter sequence upstream of the desired 20 bp sgRNA protospacer and the sgRNA backbone were generated by PCR (Q5 Hot Start MasterMix, New England Biolabs) using primers as listed in the Supplementary Information and concentrated on minelute columns (Qiagen). sgRNA was transcribed with the HiScribe T7 High Yield RNA Synthesis Kit (New England Biolabs) at 16° C. for 14-16 h with 1 μg of linear template per 20 μL reaction. sgRNA was purified using the MEGAClear Transcription Clean Up Kit (Thermo Fisher), according to the manufacturer's instructions. Purified sgRNAs were stored in aliquots at −80° C.

In Vitro Deamination Assays

Sequences of DNA oligonucleotides used as templates for the in vitro deamination assay are shown in Supplementary Note 3. All oligonucleotides were purchased from IDT. Single-stranded oligonucleotides synthesized with complementary sequences were combined (5 μL of a 100 μM solution) in Tris buffer pH 8.0 and annealed by heating to 95° C. for 5 min, followed by a gradual cooling to 37° C. at a rate of 0.1° C. second$^{-1}$ to generate 79 base pair (bp) dsDNA substrates. Freshly thawed base-editor proteins (2 μM final concentration in a 10 μL reaction volume) were complexed with the indicated sgRNA (2.2 μM final concentration) in Reaction Buffer (20 mM HEPES pH 7.5, 150 mM KCl, 0.5 mM DTT, 0.1 mM EDTA, 10 mM $MgCl_2$)[37] for five minutes at room temperature. Annealed dsDNA substrates were then added to a final concentration of 250 nM. The reaction proceeded for 30 min at 37° C. before protein denaturation was performed by heating for 5 min at 99° C. Addition of PB buffer (Qiagen, 100 μL) and isopropanol (25 μL) ensured protein was dissociated from the substrate DNA. DNA was purified with Minelute columns (Qiagen) and the resulting products amplified to the top of the linear range with 15 cycles of qPCR (12 ng input DNA, 50 μL reaction volume) using a U-tolerant polymerase (Phusion U Hot Start, ThermoFisher) and primers as listed in the Supplementary Information. Amplified DNA was purified using RapidTip2 (Diffinity Genomics) and barcoded with a second round of PCR (8 cycles, 5 ng input) before being prepared for sequencing on an Illumina MiSeq as described below.

Purification and Sequencing of Genomic DNA

Genomic DNA was isolated using Agencourt DNAdvance Genomic DNA Isolation Kit (Beckman Coulter) according to the manufacturer's instructions. For the first PCR, DNA was amplified to the top of the linear range using Q5 Hot Start DNA Polymerase (NEB), according to the manufacturer's instructions but with the addition of 3% DMSO and SYBR Gold Nucleic Acid Stain (Thermo Fisher). For all amplicons, the PCR protocol used was an initial heating step of 2 min at 98° C. followed by an optimized number of amplification cycles (12 s at 98° C., 25 s at 61° C., 30 s at 72° C.). For zebrafish and for transfected cell samples, 30 ng of input DNA was used in a 50 μL reaction, for cochlear samples 20 ng was used in a 25 μL reaction. qPCR was performed to determine the optimal cycle number for each amplicon. Amplified DNA was purified using RapidTip2 (Diffinity Genomics) and barcoded with a further PCR (8 cycles, 5 ng input). The unique forward and reverse primers used in the first-round PCR contained a constant region 5' to the annealing region, (forward: 5'-ACACTCTTTCCCTA-CACGACGCTCTTCCGATCTNNNN-3' (SEQ ID NO: 502), reverse: 5'-TGGAGTTCAGACGTGTGCTCTTCC-GATCT-3'(SEQ ID NO: 503)) which facilitated binding of barcoding primers to amplified DNA for a second-round PCR.

The second-round PCR used primers with three regions: a 5' constant region allowing the amplicon to bind to the Illumina flow cell (italicized), an 8-base barcoding region (X), and a 3' constant region allowing the barcoding primer to bind to the first-round PCR amplicon (in bold). Examples of primer sequences are:

forward: 5'-AATGATACGGCGACCACCGAGATCTACACXXXXXXXXXA (SEQ ID NO: 504)

CACTCTTTCCCTACACGAC-3' reverse: 5'-CAAGCAGAAGACGGCATACGAGATXXXXXXXGTGACTG (SEQ ID NO: 505)

GAGTTCAGACGTGTGCTCTTC-3'

Sequencing adapters and dual-barcoding sequences are based on the TruSeq Indexing Adapters (Illumina). Barcoded samples were pooled and purified by gel extraction (Qiagen), and then purified using Ampure beads (Beckman Coulter) before quantification using the Qubit dsDNA HS Kit (Thermo Fisher) and qPCR (KAPA BioSystems) according to the manufacturer's instructions. Sequencing of pooled samples was performed using a single-end read from 180-250 bases (depending on the amplicon size) on the MiSeq (Illumina) according to the manufacturer's instructions.

Sequences of oligonucleotides used for PCR amplification are shown in Supplementary Note 3. All oligonucleotides were obtained from IDT. The optimized number of PCR cycles for each amplicon in this study are as follows: VEGFA site 2 human genomic DNA (annealing temperature was 61° C. for 25 seconds for all extension steps): on-target: 29 cycles, off-target #1: 32 cycles, off-target #2: 28 cycles, off-target #3: 27 cycles, off-target #4: 27 cycles, VEGFA site 2 murine genomic DNA: on-target: 31 cycles, off-targets #1, #2, #3 and #4: 31 cycles. HEK293 site 3: off-targets #1: 29 cycles, off-target #2: 28 cycles, off-target #3: 28 cycles. FANCF off-target #1: 29 cycles, off-target #2: 28 cycles, off-target 3: 28 cycles. EMX1 off-targets #1, #2 and #3: 28 cycles. TYR1, TYR2 and TYR3 sgRNAs for amplification of zebrafish DNA: 32 cycles. Optimized protocols for the on-target amplification of the EMX1, FANCF, and HEK293 site 3 loci were followed as previously described[14].

Analysis and Alignment of Genomic DNA Sequencing Reads

Sequencing reads were analyzed as previously described[14]. In brief, sequencing reads were demultiplexed using MiSeq Reporter (Illumina), and individual FASTQ files were analyzed with a previously reported custom Matlab script[14]. Reads were aligned to the reference sequence using the Smith-Waterman algorithm. Base calls with Q-scores below 30 were replaced with a placeholder nucleotide (N). This quality threshold results in nucleotide frequencies with an expected error rate of 1 in 1,000. Indel frequencies were quantified with a previously published custom Matlab script which counts indels which occurring in a 30-base window around the nCas9 cleavage site and are a minimum of 2-base insertions or deletions[14]. Indels were defined as detectable if there was a significant difference (Student's two-tailed t-test, p<0.05) between indel formation in the treated sample and untreated control.

For one of the sequenced amplicons, CFD off-target #3, associated with VEGFA site 2 sgRNA in the murine genome, it was not possible to accurately measure indel formation. The protospacer at this locus is directly preceded by 12 guanine bases, which makes PCR and high-throughput sequencing of this site prone to random insertion or deletions; deletion rates as high as 20% of sequencing reads were observed in multiple independent untreated control samples. Since no significant base editing was detected at this off-target locus under any treatment conditions (FIGS. 132 and 133), it is suspected that indel formation is also negligible at this locus.

A phred.II Q30 score corresponds to an estimated 99.9% accuracy in basecalling[38]. A 0.1% probability of incorrect base calling at a given position corresponds to a lower limit for base calling of 0.1/4=0.025% if it is assumed base call errors are randomly distributed across the four bases. C→T editing percentages that fell beneath this threshold were classified as undetectable. Spontaneous deamination[39] or polymerase error during PCR can also introduce artefactual C→T edits. In order to distinguish base editor-induced C→T editing from artefactual C→T editing rates, untreated control cells were sequenced for each amplicon and it was calculated whether the C→T editing under a particular condition was statistically significant using the Student's two-tailed t-test with p<0.05 as the threshold. Off-target sites with statistically significant editing rates >0.025% were considered measureable. The number of aligned and quality filtered reads for each sample has been included in Table 17.

Statistical Analyses of Genomic DNA Sequence Alignments

Unless otherwise noted, mean values cited throughout the main text are representative of n≥3 independent biological replicates and the mean±standard deviation has been stated.

The statistical analysis of the high-throughput sequencing data displayed in FIGS. 2 and 3 was performed by comparing on- and off-target editing percentages in treated samples to any editing measured in a negative control sample (untreated). The Student's two-tailed t test was used, and individual p-values are shown in Table 16. * p≤0.05,  p≤0.01 and * p≤0.001. When editing was below the detection limit (0.025%), significance was not calculated; all untreated control samples showed undetectable editing.

For FIG. 128A, mean on-target base editing was calculated by averaging editing of cytosines in the base editing activity window ($C_4$-$C_8$ for HEK293 site 3 and EMX1, $C_4$-$C_9$ for FANCF and VEGFA site 2).

To account for sgRNA-dependent differences in base editing activity, the a base editing:indel ratio was calculated (FIG. 130B). This ratio was generated by dividing the percentage of HTS reads with a C→T conversion (averaged across the base editing window for each site) by the percentage of HTS reads containing an indel. As described above, if the off-target editing for a particular locus was below the limit of detection it was conservatively assumed the estimated upper bound of the detection method (0.025%) for the purpose of calculating specificity ratios.

Data Analysis of In Vitro Edited DNA

Sequencing reads were automatically demultiplexed using MiSeq Reporter (Illumina.). Quality filtering was performed using the online package usegalaxy.org[40]. Individual bases with an Illumina quality score less than or equal to 30 were converted to the placeholder nucleotide 'N' using FASTQ Groomer followed by FASTA Masker[41]. The resulting quality-filtered FASTQ files were subsequently analysed with a custom python script provided in Supplementary Note 1. Sequencing reads were scanned for exact matches to two 14-base sequences that flank both sides of the target DNA sequence. If no exact matches were found, the read was excluded from analysis. If both 14-base sequences were located and the length of the sequence between them was equal to the expected protospacer length (20 bases), the protospacer sequence found between the flanking regions was saved and the bases called by high-throughput sequencing at each site within the protospacer were tallied.

Cell Culture

Both HEK293T (ATCC CRL-3216) and NIH/3T3 (ATCC CRL-1658) were maintained in Dulbecco's Modified Eagle's Medium plus GlutaMax (ThermoFisher) supplemented with 10% (v/v) fetal bovine serum (FBS), at 37° C.

with 5% $CO_2$. Cells were obtained from ATCC and were authenticated and verified to be free of *mycoplasma* by ATCC upon purchase.

Plasmid Transfection of Base Editors into HEK293T Cells

HEK293T cells were seeded on 48-well collagen-coated BioCoat plates (Corning) in antibiotic free medium and transfected at approximately 70% confluency. Unless otherwise noted, 750 ng of BE and 250 ng of sgRNA expression plasmids were transfected using 1.5 µl of LIPOFECTAMINE® 2000 transfection reagent (Thermo Fisher) per well according to the manufacturer's protocol.

Protein Transfection of Base Editors into HEK293T Cells

HEK293T cells were seeded on 48-well collagen-coated BioCoat plates (Corning) in 250 µL antibiotic free medium and transfected at approximately 70% confluency. Base editor protein and was incubated with 1.1× molar excess of the necessary sgRNA at room temperature for 5 min. The complex was then incubated with 1.5 µL LIPOFECTAMINE® 2000 transfection reagent (Thermo Fisher) and transfected according to the manufacturer's protocol for plasmid delivery. Unless otherwise noted, BE protein was added to a final concentration of 200 nM (based on a total well volume of 275 µL).

Plasmid Transfection of Base Editors into NIH/3T3 Cells

NIH/3T3 cells were seeded on 48-well collagen-coated BioCoat plates (Corning) in antibiotic-free DMEM medium and transfected at approximately 75% confluency. Unless otherwise noted, 600 ng of BE and 200 ng of sgRNA expression plasmids were transfected using 1.4 µL of LIPOFECTAMINE® 3000 transfection reagent with 1 µL of P3000 reagent (Thermo Fisher) per well according to the manufacturer's protocol.

Protein Transfection of Base Editors into NIH/3T3 Cells

NIH/3T3 cells were seeded on 48-well collagen-coated BioCoat plates (Corning) in antibiotic free DMEM medium and transfected at approximately 75% confluency. Base editor proteins were incubated with 1.1-fold molar excess of the indicated sgRNA at 25° C. for 5 min. The complex was then incubated with 1.4 µL LIPOFECTAMINE® 3000 transfection reagent (Thermo Fisher) and transfected according to the manufacturer's protocol for plasmid delivery. P3000 reagent was not used because its addition lead to protein precipitation and a reduction in base editing efficiency. Unless otherwise noted, BE protein was added to a final concentration of 400 nM (based on a total well volume of 275 µL).

Intracochlear Delivery of BE3 Protein:Guide RNA Encapsulated in Cationic Lipid

All animal experiments were approved by the Institutional Animal Care and the Use Committee of the Massachusetts Eye and Ear Infirmary. Intracochlear delivery was performed in P1-P2 mice of a mixed genetic background as described previously[42]. Mice were anesthetized by lowering body temperature before the surgical procedure. A postauricular incision was made near the right ear, and the bulla was lifted to expose the cochlea. BE3 protein (57.7 µM) was pre-complexed with the sgRNA (100 µM) in a 1:1.1 molar ratio and then mixed with LIPOFECTAMINE® 2000 transfection reagent (Thermo Fisher) in a 1:1 volumetric ratio. The resulting solution (1.2-1.5 µL) was injected with a glass pipette (end diameter, 5 µm) through the cochlear capsule into scala media at the cochlear basal turn that attached to a nanoliter micropump (WPI, UMP3+Micro4+NanoFil) at the rate of 250 nL $min^{-1}$. After injection, the incision was closed and the mice were brought onto a heating pad to recover. After 3-4 days, the cochlea of mouse was dissected into the organ of *Corti*, stria vascularis, and modiolus. Each tissue was further micro-dissected into between 5 and 7 separate pieces and DNA extraction was performed separately for each sample, followed by high-throughput sequencing as described above. The data presented in FIG. 132 and FIG. 134 show sequencing data resulting from extraction of one micro-dissected sample for each cochlear region.

Microinjection of BE3 Protein:Guide RNA into Zebrafish Embryo

Zebrafish (Tuebingen strain) were maintained under standard conditions in compliance with internal regulatory review at Boston Children's Hospital. One-cell stage zebrafish embryos were injected with approximately 2 nL of BE3 protein pre-complexed with the appropriate sgRNA or an unrelated sgRNA control in a 1:1 molar ratio (4.5 µM final concentration). Four days post-fertilization, DNA was extracted from larvae as previously described[43] in 50 mM NaOH for 30 minutes at 95° C. and the resulting solution was neutralized with Tris-HCl. Genomic DNA was quantified, amplified by PCR, and sequenced as described above.

Protein Gel Analyses

All protein gels shown were precast 4-12% polyacrylamide Bis-Tris Plus (Thermo Fisher). They were run in MOPS buffer (Thermo Fisher) at 180 V for 50 min. Samples were prepared for loading by heating to 99° C. in 100 mM DTT and 1× lithium dodecyl sulfate (LDS) Sample Buffer for denaturation (Thermo Fisher) for 10 min. Gels were stained using Instant Blue Protein Stain (Expedion) according to manufacturer's instructions.

For cell lysate analysis, 2 mL of post-induction overnight culture was pelleted at 15,000 g before lysis in 100 µL B-PER (Thermo Fisher) according to the manufacturer's instructions.

Data Availability

High-throughput sequencing data that support the findings of this study have been deposited in the NCBI Sequence Read Archive database under Accession Number SRP097884. Plasmids encoding HF-BE3 and BE3 for protein expression, as well as HF-BE3 for mammalian expression, are available from Addgene with Accession IDs 87439 (pCMV-HF-BE3), 87438 (pET42b-HF-BE3), 87437 (pET42b-BE3).

REFERENCES

1 Cox, D. B., Platt, R. J. & Zhang, F. Therapeutic genome editing: prospects and challenges. *Nature medicine* 21, 121-131, doi:10.1038/nm.3793 (2015).

2 Doudna, J. A. & Charpentier, E. Genome editing. The new frontier of genome engineering with CRISPR-Cas9. *Science* 346, 1258096, doi:10.1126/science.1258096 (2014).

3 Komor, A. C., Badran, A. H. & Liu, D. R. CRISPR-Based Technologies for the Manipulation of Eukaryotic Genomes. *Cell* 168, 20-36, doi:10.1016/j.cell.2016.10.044 (2017).

4 Sander, J. D. & Joung, J. K. CRISPR-Cas systems for editing, regulating and targeting genomes. *Nature biotechnology* 32, 347-355, doi:10.1038/nbt.2842 (2014).

Hilton, I. B. & Gersbach, C. A. Enabling functional genomics with genome engineering. *Genome Res* 25, 1442-1455, doi:10.1101/gr.190124.115 (2015).

6 Wyman, C. & Kanaar, R. DNA double-strand break repair: all's well that ends well. *Annual review of genetics* 40, 363-383, doi:10.1146/annurev.genet.40.110405.090451 (2006).

7 Ran, F. A. et al. Genome engineering using the CRISPR-Cas9 system. *Nat Protoc* 8, 2281-2308, doi:10.1038/nprot.2013.143 (2013).

8 Cong, L. et al. Multiplex genome engineering using CRISPR/Cas systems. *Science* 339, 819-823, doi:10.1126/science.1231143 (2013).
9 Bodles-Brakhop, A. M., Heller, R. & Draghia-Akli, R. Electroporation for the Delivery of DNA-based Vaccines and Immunotherapeutics: Current Clinical Developments. *Mol Ther* 17, 585-592, doi:10.1038/mt.2009.5 (2009).
Kay, M. A., Glorioso, J. C. & Naldini, L. Viral vectors for gene therapy: the art of turning infectious agents into vehicles of therapeutics. *Nature medicine* 7, 33-40, doi: Doi 10.1038/83324 (2001).
11 Midoux, P., Pichon, C., Yaouanc, J. J. & Jaffres, P. A. Chemical vectors for gene delivery: a current review on polymers, peptides and lipids containing histidine or imidazole as nucleic acids carriers. *Brit J Pharmacol* 157, 166-178, doi:10.1111/j.1476-5381.2009.00288.x (2009).
12 Yin, H. et al. Genome editing with Cas9 in adult mice corrects a disease mutation and phenotype. *Nature biotechnology* 32, 551-553, doi:10.1038/nbt0914-952d (2014).
13 Hu, J. H., Davis, K. M. & Liu, D. R. Chemical Biology Approaches to Genome Editing: Understanding, Controlling, and Delivering Programmable Nucleases. *Cell chemical biology* 23, 57-73, doi:10.1016/j.chembiol.2015.12.009 (2016).
14 Komor, A. C., Kim, Y. B., Packer, M. S., Zuris, J. A. & Liu, D. R. Programmable editing of a target base in genomic DNA without double-stranded DNA cleavage. *Nature* 533, 420-424, doi:10.1038/nature17946 (2016).
Hess, G. T. et al. Directed evolution using dCas9-targeted somatic hypermutation in mammalian cells. *Nature methods* 13, 1036-1042, doi:10.1038/nmeth.4038 (2016).
16 Ma, Y. et al. Targeted AID-mediated mutagenesis (TAM) enables efficient genomic diversification in mammalian cells. *Nature methods* 13, 1029-1035, doi:10.1038/nmeth.4027 (2016).
17 Nishida, K. et al. Targeted nucleotide editing using hybrid prokaryotic and vertebrate adaptive immune systems. *Science* 353, aaf8729, doi:10.1126/science.aaf8729 (2016).
18 Li, J., Sun, Y., Du, J., Zhao, Y. & Xia, L. Generation of targeted point mutations in rice by a modified CRISPR/Cas9 system. *Mol Plant* In Press, doi:10.1016/j.molp.2016.12.001 (2016).
19 Koyama, S., Ishii, K. J., Coban, C. & Akira, S. Innate immune response to viral infection. *Cytokine* 43, 336-341, doi:10.1016/j.cyto.2008.07.009 (2008).
20 Kleinstiver, B. P. et al. High-fidelity CRISPR-Cas9 nucleases with no detectable genome-wide off-target effects. *Nature* 529, 490-495, doi:10.1038/nature16526 (2016).
21 Hsu, P. D. et al. DNA targeting specificity of RNA-guided Cas9 nucleases. *Nature biotechnology* 31, 827-832, doi:10.1038/nbt.2647 (2013).
22 Fu, Y. F. et al. High-frequency off-target mutagenesis induced by CRISPR-Cas nucleases in human cells. *Nature biotechnology* 31, 822-826, doi:10.1038/nbt.2623 (2013).
23 Pattanayak, V. et al. High-throughput profiling of off-target DNA cleavage reveals RNA-programmed Cas9 nuclease specificity. *Nature biotechnology* 31, 839-843, doi:10.1038/nbt.2673 (2013).
24 Tsai, S. Q. et al. GUIDE-seq enables genome-wide profiling of off-target cleavage by CRISPR-Cas nucleases. *Nature biotechnology* 33, 187-197, doi:10.1038/nbt.3117 (2015).
Guilinger, J. P. et al. Broad specificity profiling of TALENs results in engineered nucleases with improved DNA-cleavage specificity. *Nature methods* 11, 429-435, doi:10.1038/nmeth.2845 (2014).
26 Singh, R., Kuscu, C., Quinlan, A., Qi, Y. J. & Adli, M. Cas9-chromatin binding information enables more accurate CRISPR off-target prediction. *Nucleic acids research* 43, 677-683, doi:ARTN e118 10.1093/nar/gkv575 (2015).
27 Liang, X. Q. et al. Rapid and highly efficient mammalian cell engineering via Cas9 protein transfection. *J Biotechnol* 208, 44-53, doi:10.1016/j.jbiotec.2015.04.024 (2015).
28 Wang, M. et al. Efficient delivery of genome-editing proteins using bioreducible lipid nanoparticles. *Proceedings of the National Academy of Sciences of the United States of America* 113, 2868-2873, doi:10.1073/pnas.1520244113 (2016).
29 Zuris, J. A. et al. Cationic lipid-mediated delivery of proteins enables efficient protein-based genome editing in vitro and in vivo. *Nature biotechnology* 33, 73-80, doi:10.1038/nbt.3081 (2015).
30 DeWitt, M. A. et al. Selection-free genome editing of the sickle mutation in human adult hematopoietic stem/progenitor cells. *Sci Transl Med* 8, 360ra134, doi:10.1126/scitranslmed.aaf9336 (2016).
31 Kim, K. et al. Highly efficient RNA-guided base editing in mouse embryos. *Nature biotechnology*, doi:10.1038/nbt.3816 (2017).
32 Richardson, C. D., Ray, G. J., DeWitt, M. A., Curie, G. L. & Corn, J. E. Enhancing homology-directed genome editing by catalytically active and inactive CRISPR-Cas9 using asymmetric donor DNA. *Nature biotechnology* 34, 339-344, doi:10.1038/nbt.3481 (2016).
33 Lin, Y. C. et al. Genome dynamics of the human embryonic kidney 293 lineage in response to cell biology manipulations. *Nature communications* 5, 4767, doi:10.1038/ncomms5767 (2014).
34 Davis, K. M., Pattanayak, V., Thompson, D. B., Zuris, J. A. & Liu, D. R. Small molecule-triggered Cas9 protein with improved genome-editing specificity. *Nat Chem Biol* 11, 316-318, doi:10.1038/Nchembio.1793 (2015).
Lin, S., Staahl, B., Alla, R. K. & Doudna, J. A. Enhanced homology-directed human genome engineering by controlled timing of CRISPR/Cas9 delivery. *Elife*, e04766, doi:10.7554/eLife.04766 (2014).
36 Doench, J. G. et al. Optimized sgRNA design to maximize activity and minimize off-target effects of CRISPR-Cas9. *Nature biotechnology* 34, 184-191, doi:10.1038/nbt.3437 (2016).
37 Jinek, M. et al. A Programmable Dual-RNA-Guided DNA Endonuclease in Adaptive Bacterial Immunity. *Science* 337, 816-821, doi:10.1126/science.1225829 (2012).
38 Ewing, B. & Green, P. Base-calling of automated sequencer traces using phred. II. Error probabilities. *Genome Res* 8, 186-194 (1998).
39 Liu, M. & Schatz, D. G. Balancing AID and DNA repair during somatic hypermutation. *Trends in immunology* 30, 173-181, doi:10.1016/j.it.2009.01.007 (2009).
40 Afgan, E. et al. The Galaxy platform for accessible, reproducible and collaborative biomedical analyses: 2016 update. *Nucleic acids research* 44, W3-W10, doi:10.1093/nar/gkw343 (2016).
41 Blankenberg, D. et al. Manipulation of FASTQ data with Galaxy. *Bioinformatics* 26, 1783-1785, doi:10.1093/bioinformatics/btq281 (2010).
42 Hu, L. X. et al. Diphtheria Toxin-Induced Cell Death Triggers Wnt-Dependent Hair Cell Regeneration in Neonatal Mice. *J Neurosci* 36, 9479-9489, doi:10.1523/Jneurosci.2447-15.2016 (2016).

43 Meeker, N. D., Hutchinson, S. A., Ho, L. & Trede, N. S. Method for isolation of PCR-ready genomic DNA from zebrafish tissues. *Biotechniques* 43, 610, 612, 614 (2007).

44 Zuris, J. A. et al. Cationic lipid-mediated delivery of proteins enables efficient protein-based genome editing in vitro and in vivo. Nature biotechnology 33, 73-80 (2015).

45 Tsai, S. Q. et al. GUIDE-seq enables genome-wide profiling of off-target cleavage by CRISPR-Cas nucleases. Nature biotechnology 33, 187-197 (2015).

46 Doench, J. G. et al. Optimized sgRNA design to maximize activity and minimize off-target effects of CRISPR-Cas9. Nature biotechnology 34, 184-191 (2016).

47 Haeussler, M. et al. Evaluation of off-target and on-target scoring algorithms and integration into the guide RNA selection tool CRISPOR. Genome Biol 17, 148 (2016).

Supplementary Information

Supplementary Note 1: Python script used to analyze quality-filtered in vitro-edited DNA.

```
1.   from_future_import print_function
2.   from_future_import division
3.
4.   import Bio #This will import the BioPython suite
5.   from Bio import SeqIO #Necessary to read/write sequence handles
6.   from Bio.Seq import Seq
7.   import os
8.   import collections
9.   import csv
10.
11.  inputfile = "please_specify_your_input_file_here_containing_filtered_reads" #specify
the filenames that contain sequences
12.  filenames = [ ]
13.
14.  for file in os.listdir(inputfile):
15.      if file.endswith(".fastqsanger"):
16.          filenames.append(file)
17.
18.  spacer = [ ]
19.  list_of_filenames = [ ]
20.
21.  for file in filenames:
22.      site = { }
23.      output = open(file + ".txt", "w")
24.      list_of_filenames.append(file + ".txt") #allows calling of the txt files that come
from fastq files later
25.      for rec in SeqIO.parse(file, "fastq"):
26.          split1=rec.seq.tostring( ).split("GTTCGCGGCGATCG") #14-
base pair constant_region_before_protospacer
27.          if len(split1)>=2:
28.              split2=split1[1].split("TGGATCGCCTGGCA") #14-
base pairc constant_region_after_protospacer
29.              site=split2[0]
30.              if len(site)==20:
31.                  output.write(site + "\n")
32.
33.  BASES = 'ATGCN'
34.  UNRECOGNIZED = 'X'
35.  BASE_SEPERATOR = dict(zip(BASES, ',,,,\n'))
36.  a_index = 0
37.  t_index = 1
38.  g_index = 2
39.  c_index = 3
40.  n_index = 4
41.
42.  def get_counts_by_column(base, count, library):
43.      current_count = library[count]
44.      if_base == 'A':
45.          current_count[a_index] += 1
46.      elif base == 'T':
47.          current_count[t_index] += 1
48.      elif base == 'G':
49.          current_count[g_index] += 1
50.      elif base == 'C':
51.          current_count[c_index] += 1
52.      elif base == 'N':
53.          current_count[n_index] += 1
54.
55.  def dna_counts(list_of_sequences, sample):
56.      first_oligo = list_of_sequences[0]
57.      for i in range (len(first_oligo)):
58.          sample.append([0,0,0,0,0])
59.      for j in range(len(first_oligo)):
60.          for i in range(len(list_of_sequences)):
61.              get_counts_by_column(list_of_sequences[i][j], j, libname)
62.
63.
```

Supplementary Note 1: Python script used to analyze quality-filtered in vitro-edited DNA.

```
64. for file in list_of_filenames:
65.     spacer_list = open(file).read( ).splitlines( )
66.     output2=[ ]
67.     dna_counts(spacer_list, output2)
68.     with open(file + ".csv", "wb") as f:
69.         writer = csv.writer(f)
70.         writer.writerows(output2)
```

Supplementary Note 2:
Sequences of proteins used in this study

Protein sequence of expressed BE3
(SEQ ID NO: 185)
MGSSHHHHHHSSETGPVAVDPTLRRRIEPHEFEVFFDPRELRKETCLLYE
INWGGRHSIWRHTSQNTNKHVEVNFIEKFTTERYFCPNTRCSITWFLSWS
PCGECSRAITEFLSRYPHVTLFIYIARLYHHADPRNRQGLRDLISSGVTI
QIMTEQESGYCWRNFVNYSPSNEAHWPRYPHLWVRLYVLELYCIILGLPP
CLNILRRKQPQLTFFTIALQSCHYQRLPPHILWATGLKSGSETPGTSESA
TPESDKKYSIGLAIGTNSVGWAVITDEYKVPSKKFKVLGNTDRHSIKKNL
IGALLFDSGETAEATRLKRTARRRYTRRKNRICYLQEIFSNEMAKVDDSF
FHRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSLG
LTPNFKSNFDLAEDAKLQLSKDTYDDDLDNLLAQIGDQYADLFLAAKNLS
DAILLSDILRVNTEITKAPLSASMIKRYDEHHQDLTLLKALVRQQLPEKY
KEIFFDQSKNGYAGYIDGGASQEEFYKFIKPILEKMDGTEELLVKLNRED
LLRKQRTFDNGSIPHQIHLGELHAILRRQEDFYPFLKDNREKIEKILTFR
IPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKA
IVDLLFKTNRKVTVKQLKEDYFKKIECFDSVEISGVEDRFNASLGTYHDL
LKIIKDKDFLDNEENEDILEDIVLTLTLFEDREMIEERLKTYAHLFDDKV
MKQLKRRRYTGWGRLSRKLINGIRDKQSGKTILDFLKSDGFANRNFMQLI
HDDSLTFKEDIQKAQVSGQGDSLHEHIANLAGSPAIKKGILQTVKVVDEL
VKVMGRHKPENIVIEMARENQTTQKGQKNSRERMKRIEEGIKELGSQILK
EHPVENTQLQNEKLYLYYLQNGRDMYVDQELDINRLSDYDVDHIVPQSFL
KDDSIDNKVLTRSDKNRGKSDNVPSEEVVKKMKNYVVRQLLNAKLITQRK
FDNLTKAERGGLSELDKAGFIKRQLVETRQITKHVAQILDSRMNTKYDEN
DKLIREVKVITLKSKLVSDFRKDFQFYKVREINNYHHAHDAYLNAVVGTA
LIKKYPKLESEFVYGDYKVYDVRKMIAKSEQEIGKATAKYFFYSNIMNFF
KTEITLANGEIRKRPLIETNGETGEIVWDKGRDFATVRKVLSMPQVNIVK
KTEVQTGGFSKESILPKRNSDKLIARKKDWDPKKYGGFDSPTVAYSVLVV
AKVEKGKSKKLKSVKELLGITIMERSSFEKNPIDFLEAKGYKEVKKDLII
KLPKYSLFELENGRKRMLASAGELQKGNELALPSKYVNFLYLASHYEKLK
GSPEDNEQKQLFVEQHKHYLDEIIEQISEFSKRVILADANLDKVLSAYNK HRDKPIREQAENIIHLFTLTNLGAPAAFKYFDTTIDRKRYTSTKEVLDAT
LIHQSITGLYETRIDLSQLGGDSGGSTNLSDIIEKETGKQLVIQESILML
PEEVEEVIGNKPESDILVHTAYDESTDENVMLLTSDAPEYKPWALVIQDS
NGENKIKMLSGGSPKKKRKV Protein sequence of expressed HF-BE3
(SEQ ID NO: 186)
MGSSHHHHHHSSETGPVAVDPTLRRRIEPHEFEVFFDPRELRKETCLLYE
INWGGRHSIWRHTSQNTNKHVEVNFIEKFTTERYFCPNTRCSITWFLSWS
PCGECSRAITEFLSRYPHVTLFIYIARLYHHADPRNRQGLRDLISSGVTI
QIMTEQESGYCWRNFVNYSPSNEAHWPRYPHLWVRLYVLELYCIILGLPP
CLNILRRKQPQLTFFTIALQSCHYQRLPPHILWATGLKSGSETPGTSESA
TPESDKKYSIGLAIGTNSVGWAVITDEYKVPSKKFKVLGNTDRHSIKKNL
IGALLFDSGETAEATRLKRTARRRYTRRKNRICYLQEIFSNEMAKVDDSF
FHRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSLG
LTPNFKSNFDLAEDAKLQLSKDTYDDDLDNLLAQIGDQYADLFLAAKNLS
DAILLSDILRVNTEITKAPLSASMIKRYDEHHQDLTLLKALVRQQLPEKY
KEIFFDQSKNGYAGYIDGGASQEEFYKFIKPILEKMDGTEELLVKLNRED
LLRKQRTFDNGSIPHQIHLGELHAILRRQEDFYPFLKDNREKIEKILTFR
IPYYVGPLARGNSRFAWMTRKSEETITPWNFEEVVDKGASAQSFIERMTA
FDKNLPNEKVLPKHSLLYEYFTVYNELTKVKYVTEGMRKPAFLSGEQKKA
IVDLLFKTNRKVTVKQLKEDYFKKIECFDSVEISGVEDRFNASLGTYHDL
LKIIKDKDFLDNEENEDILEDIVLTLTLFEDREMIEERLKTYAHLFDDKV
MKQLKRRRYTGWGALSRKLINGIRDKQSGKTILDFLKSDGFANRNFMALI
HDDSLTFKEDIQKAQVSGQGDSLHEHIANLAGSPAIKKGILQTVKVVDEL
VKVMGRHKPENIVIEMARENQTTQKGQKNSRERMKRIEEGIKELGSQILK
EHPVENTQLQNEKLYLYYLQNGRDMYVDQELDINRLSDYDVDHIVPQSFL
KDDSIDNKVLTRSDKNRGKSDNVPSEEVVKKMKNYVVRQLLNAKLITQRK
FDNLTKAERGGLSELDKAGFIKRQLVETRAITKHVAQILDSRMNTKYDEN
DKLIREVKVITLKSKLVSDFRKDFQFYKVREINNYHHAHDAYLNAVVGTA
LIKKYPKLESEFVYGDYKVYDVRKMIAKSEQEIGKATAKYFFYSNIMNFF Supplementary Note 2:
Sequences of proteins used in this study

KTEITLANGEIRKRPLIETNGETGEIVWDKGRDFATVRKVLSMPQVNIVK

KTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLII

KLPKYSLFELENGRKRMLASAGELQKGNELALPSKYVNFLYLASHYEKLK

GSPEDNEQKQLFVEQHKHYLDEIIEQISEFSKRVILADANLDKVLSAYNK

Supplementary Note 2:
Sequences of proteins used in this study

HRDKPIREQAENIIHLFTLTNLGAPAAFKYFDTTIDRKRYTSTKEVLDAT

LIHQSITGLYETRIDLSQLGGDSGGSTNLSDIIEKETGKQLVIQESILML

PEEVEEVIGNKPESDILVHTAYDESTDENVMLLTSDAPEYKPWALVIQDS

NGENKIKMLSGGSPKKKRKV

Supplementary Note 3: Sequences of oligonucleotides used in the present study

Unpublished Primers used to amplify off target genomic DNA for HTS in human cells
(SEQ ID NOS: 506-513)

fwd_VEGFA_site2_off_target_1_human    ACACTCTTTCCCTACACGACGCTCTTCCGATCTNNNNTCCTACAAGTAACAGTCCAAGAA rev_VEGFA_site2_off_target_1_human    TGGAGTTCAGACGTGTGCTCTTCCGATCTTTCTGCAACTTAACTTACGTGAAA fwd_VEGFA_site2_off_target_2_human    ACACTCTTTCCCTACACGACGCTCTTCCGATCTNNNNACCAAGCCCATTTGTCCAGG rev_VEGFA_site2_off_target_2_human    TGGAGTTCAGACGTGTGCTCTTCCGATCTTCCTTCTTTTTGAGCTTTGGGC fwd_VEGFA_site2_off_target_3_human    ACACTCTTTCCCTACACGACGCTCTTCCGATCTNNNNTCCATACCAGCAGCAGTTCC rev_VEGFA_site2_off_target_3_human    TGGAGTTCAGACGTGTGCTCTTCCGATCTCTCACCTCAGCTCCTGCAC fwd_VEGFA_site2_off_target_4_human    ACACTCTTTCCCTACACGACGCTCTTCCGATCTNNNNCCCACTGATTCTACACCATGGT rev_VEGFA_site2_off_target_4_human    TGGAGTTCAGACGTGTGCTCTTCCGATCTGGAGTTCCCAACCTTTTTGACA Other primers (for off target sites associated with HEK_3, EMX1, FANCF) were previously published Primers used to amplify off target genomic DNA for HTS in murine cells
(SEQ ID NOS: 514-521)

fwd_VEGFA_site2_off_target_1_murine   ACACTCTTTCCCTACACGACGCTCTTCCGATCTNNNNCTGGCTGGAGATTCAGAGACAC rev_VEGFA_site2_off_target_1_murine   TGGAGTTCAGACGTGTGCTCTTCCGATCTCTGCCCCTTCTGACACACATAC fwd_VEGFA_site2_off_target_2_murine   ACACTCTTTCCCTACACGACGCTCTTCCGATCTNNNNACCCCTCAAGGCTTGACATTTC rev_VEGFA_site2_off_target_2_murine   TGGAGTTCAGACGTGTGCTCTTCCGATCTTGAAAAGTTGGGAGAGGGGATG fwd_VEGFA_site2_off_target_3_murine   ACACTCTTTCCCTACACGACGCTCTTCCGATCTNNNNTTTGTACCCCAGTCCCCTCATC rev_VEGFA_site2_off_target_3_murine   TGGAGTTCAGACGTGTGCTCTTCCGATCTTGAAGTTACGGGGATGTCACTTG fwd_VEGFA_site2_off_target_4_murine   ACACTCTTTCCCTACACGACGCTCTTCCGATCTNNNNTTAACATCCAGTCTCCCAAACACA rev_VEGFA_site2_off_target_4_murine   TGGAGTTCAGACGTGTGCTCTTCCGATCTACACACACACTACTAGGACA Primers used to amplify on target genomic DNA for HTS in murine cells
(SEQ ID NOS: 522-523)

fwd_VEGFA_site2_on_target_murine      ACACTCTTTCCCTACACGACGCTCTTCCGATCTNNNNCGCTACTACGGAGCGAGAAG rev_VEGFA_site2_on_target_murine      TGGAGTTCAGACGTGTGCTCTTCCGATCTACAGGGGCAAAGTGAGTGAC Primers used for generating PCR products to serve as substrates for T7 transcription of sgRNAs
(SEQ ID NOS: 524-529)

rev_sgRNA_T7: used in all cases       AAAAAAAGCACCGACTCGGTGCCAC

Supplementary Note 3: Sequences of oligonucleotides used in the present study

| | |
|---|---|
| fwd_sgRNA_T7_EMX1 | TAATACGACTCACTATAGGGAGTCCGAGCAGAAGAAGAAGTTTTAGAGCTAGAAATAGCA |
| fwd_sgRNA_T7_FANCF | TAATACGACTCACTATAGGGGAATCCCTTCTGCAGCACCGTTTTAGAGCTAGAAATAGCA |
| fwd_sgRNA_T7_HEK_site_3 | TAATACGACTCACTATAGGGGCCCAGACTGAGCACGTGAGTTTTAGAGCTAGAAATAGCA |
| fwd_sgRNA_T7_VEGFA_site_2 | TAATACGACTCACTATAG GACCCCTCCACCCCGCCTCGTTTTAGAGCTAGAAATAGCA |
| fwd_sgRNA_T7_TC_repeat_in_vitro | TAATACGACTCACTATAGGTCTCTCTCTCTCTCTCTCGTTTTAGAGCTAGAAATAGCA |

Primers used for generating sgRNA transfection glasmids
The pFYF1320 plasmid was used as template as previously described (Komor et al). The sequence of other sgRNA plasmids was previously reported (SEQ ID NOS: 530-531)

| | |
|---|---|
| rev_sgRNA_plasmid | GGTGTTTCGTCCTTTCCACAAG |
| fwd_VEGFA_site_2 | GACCCCTCCACCCCGCCTCGTTTTAGAGCTAGAAATAGCAAGTTAAAATAAGGC |

Sequences of ssDNA substrates used in in vitro deaminase assays (SEQ ID NOS: 532-533)

| | |
|---|---|
| fwd_TC_repeat_substrate | ACGTAAACGGCCACAAGTTCGCGGCGATCGTCTCTCTCTCTCTCTCTCTGGATCGCCTGGCATCTTCTTCAAGGACG |
| rev_TC_repeat_substrate | CGTCCTTGAAGAAGATGCCAGGCGATCCAGAGAGAGAGAGAGAGAGACGATCGCCGCGAACTTGTGGCCGTTTACGT |

Previously published primers used to amplify off target genomic DNA for HTS in human cells (SEQ ID NOS: 534-557)

| | |
|---|---|
| fwd_EMX1_HTS | ACACTCTTTCCCTACACGACGCTCTTCCGATCTNNNNCAGCTCAGCCTGAGTGTTGA |
| rev_EMX1_HTS | TGGAGTTCAGACGTGTGCTCTTCCGATCTCTCGTGGGTTTGTGGTTGC |
| fwd_FANCF_HTS | ACACTCTTTCCCTACACGACGCTCTTCCGATCTNNNNCATTGCAGAGAGGCGTATCA |
| rev_FANCF_HTS | TGGAGTTCAGACGTGTGCTCTTCCGATCTGGGGTCCCAGGTGCTGAC |
| fwd_HEK293_site3_HTS | ACACTCTTTCCCTACACGACGCTCTTCCGATCTNNNNATGTGGGCTGCCTAGAAAGG |
| rev_HEK293_site3_HTS | TGGAGTTCAGACGTGTGCTCTTCCGATCTCCCAGCCAAACTTGTCAACC |
| fwd_EMX1_off1_HTS | ACACTCTTTCCCTACACGACGCTCTTCCGATCTNNNNAGTAGCCTCTTTCTCAATGTGC |
| rev_EMX1_off1_HTS | TGGAGTTCAGACGTGTGCTCTTCCGATCTGCTTTCACAAGGATGCAGTCT |
| fwd_EMX1_off2_HTS | ACACTCTTTCCCTACACGACGCTCTTCCGATCTNNNNGAGCTAGACTCCGAGGGGA |
| rev_EMX1_off2_HTS | TGGAGTTCAGACGTGTGCTCTTCCGATCTTCCTCGTCCTGCTCTCACTT |
| fwd_EMX1_0ff3_HTS | ACACTCTTTCCCTACACGACGCTCTTCCGATCTNNNNAGAGGCTGAAGAGGAAGACCA |
| rev_EMX1_off3_HTS | TGGAGTTCAGACGTGTGCTCTTCCGATCTGGCCCAGCTGTGCATTCTAT |
| fwd_FANCF_off1_HTS | ACACTCTTTCCCTACACGACGCTCTTCCGATCTNNNNAACCCACTGAAGAAGCAGGG |
| rev_FANCF_off1_HTS | TGGAGTTCAGACGTGTGCTCTTCCGATCTGGTGCTTAATCCGGCTCCAT |
| fwd_FANCF_0ff2_HTS | ACACTCTTTCCCTACACGACGCTCTTCCGATCTNNNNTCCAGTGTTTCCATCCCGAA |
| rev_FANCF_off2_HTS | TGGAGTTCAGACGTGTGCTCTTCCGATCTCCTCTGACCTCCACAACTCT |
| fwd_FANCF_off3_HTS | ACACTCTTTCCCTACACGACGCTCTTCCGATCTNNNNCTGGGTACAGTTCTGCGTGT |
| rev_FANCF_off3_HTS | TGGAGTTCAGACGTGTGCTCTTCCGATCTTCACTCTGAGCATCGCCAAG |

Supplementary Note 3: Sequences of oligonucleotides used in the present study

| | |
|---|---|
| fwd_HEK293_site3_off1_HTS | ACACTCTTTCCCTACACGACGCTCTTCCGATCTNNNNTCCCCTGTTGACCTGGAGAA |
| rev_HEK293_site3_off1_HTS | TGGAGTTCAGACGTGTGCTCTTCCGATCTCACTGTACTTGCCCTGACCA |
| fwd_HEK293_site3_off2_HTS | ACACTCTTTCCCTACACGACGCTCTTCCGATCTNNNNTGGTGTTGACAGGGAGCAA |
| rev_HEK293_site3_off2_HTS | TGGAGTTCAGACGTGTGCTCTTCCGATCTCTGAGATGTGGGCAGAAGGG |
| fwd_HEK293_site3_off3_HTS | ACACTCTTTCCCTACACGACGCTCTTCCGATCTNNNNTGAGAGGGAACAGAAGGGCT |
| rev_HEK293_site3_off3_HTS | TGGAGTTCAGACGTGTGCTCTTCCGATCTGTCCAAAGGCCCAAGAACCT |

Primers used to amplify on target genomic DNA for HTS in zebrafish
(SEQ ID NOS: 558-563)

| | |
|---|---|
| fwd_TYR1_zebrafish | ACACTCTTTCCCTACACGACGCTCTTCCGATCTNNNNGTTCCCCCGAGTCTGCACCT |
| rev_TYR1_zebrafish | TGGAGTTCAGACGTGTGCTCTTCCGATCTCGAACTTGCATTCGCCGCAA |
| fwd_TYR2_zebrafish | ACACTCTTTCCCTACACGACGCTCTTCCGATCTNNNNTTCTGCCTTGGCATCGGGTG |
| rev_TYR2_zebrafish | TGGAGTTCAGACGTGTGCTCTTCCGATCTCACCATACCGCCCCTAGAACTAACATTC |
| fwd_TYR3_zebrafish | ACACTCTTTCCCTACACGACGCTCTTCCGATCTNNNNACAACTGCTTTCCATGGTGTGT |
| rev_TYR3_zebrafish | TGGAGTTCAGACGTGTGCTCTTCCGATCTTCCCAGGGCTTTCGTGGAGA |

| Site | Sequence | SEQ ID NO |
|---|---|---|
| TYR1 | GTC$_3$AGGTC$_8$GAGGGTTCTGTCAGG | 564 |
| TYR2 | CTTC$_4$C$_5$AGGATGAGAACACAGAGG | 565 |
| TYR3 | CAAC$_4$C$_5$AC$_7$TGCTCAAAGATGCTGG | 566 |

Supplementary Table 1. Protospacer and PAM Sequences for the Zebrafish Genomic Loci Studied in this Work.

Example 17: C: G-to-T:A Base Editors with Higher Efficiency and Product Purity Base editing is the programmable conversion of target C:G base pairs to T:A base pairs without inducing double-stranded DNA breaks or requiring homology-directed repair using engineered fusions of Cas9 variants and cytidine deaminases (1). The third-generation base editor (BE3) and related technologies have been successfully used by many researchers in a wide range of organisms (2-13). The product distribution of base editing—the frequency with which the target C:G base pair is converted to mixtures of undesired byproducts, along with the desired T:A product-varies in a target site-dependent manner (2, 3, 6-8). Here we characterize determinants of base editing outcomes in human cells, and establish that the formation of undesired products is dependent on uracil N-glycosylase (UNG), and is more likely to occur at target sites containing only a single C within the base editing activity window. The constructs CDA1-BE3 and AID-BE3, which use cytidine deaminase homologs that increase base editing efficiency for some sequences, were engineered. Additionally, a fourth-generation S. pyogenes Cas9-derived base editor (BE4) that more efficiently blocks access of UNG to base-edited intermediates was also engineered. Compared with BE3, BE4 increases by approximately 50% the efficiency of C:G to T:A base editing, while halving the frequency of undesired byproducts. These improvements were also applied to yield a S. aureus Cas9-derived BE4 (SaBE4), which is substantially smaller than BE4 and has an alternative targeting scope.

Introduction

Traditional genome editing methods introduce a double-stranded DNA break (DSB) at a genomic target locus (14). The cellular response to a DSB lesion primarily proceeds through nonhomologous end joining (NHEJ) and related processes (15). Although NHEJ usually rejoins the two ends flanking the DSB, under typical genome editing conditions DSBs are continuously reintroduced, eventually resulting in the accumulation of insertions and deletions (indels) or translocations at the site of the DSB and disruption of the corresponding genomic locus (16). Actively dividing cells can also respond to DSBs by initiating homology-directed repair (HDR) in the presence of a donor DNA template containing homology to the regions surrounding the DSB, which allows researchers to more precisely and predictably manipulate genomes than is possible through NHEJ (17). HDR-dependent genome editing is limited by low efficiency arising from competition with NHEJ outcomes, and from the dependence of HDR on mitosis (18).

The development of base editing, which enables the direct, irreversible conversion of a C:G base pair to a T:A base pair in a programmable manner without requiring HDR or the introduction of a DSB, has been reported (1). Base editors consist of a single-stranded DNA-specific cytidine deaminase enzyme tethered to a catalytically impaired Cas9 protein and a base excision repair inhibitor (1, 4, 9, 10). The Cas9 variant binds a genomic locus of interest, programmed by a corresponding guide RNA. Formation of the protein: RNA:DNA ternary "R-loop" complex (19) exposes a small (~5-nt) window of single-stranded DNA that serves as a substrate for the tethered cytidine deaminase enzyme. Any cytidines within this window are hydrolytically deaminated to uracils, resulting in G:U intermediates.

Base excision repair (BER) is the cell's primary response to G:U mismatches and is initiated by excision of the uracil by uracil N-glycosylase (UNG)(20). In an effort to protect the edited G:U intermediate from excision by UNG, an 83-amino acid uracil glycosylase inhibitor (UGI) was fused directly to the C-terminus of catalytically dead Cas9 (dCas9) (1). To manipulate cellular DNA mismatch repair systems into preferentially replacing the G in the G:U mismatch with an A, the Ala 840 amino acid in dCas9 was reverted to His, enabling the Cas9 protein to nick the DNA strand opposite the newly formed uracil, resulting in much more efficient conversion of the G:U intermediate to desired A:U and A:T products (1). Combining these two engineering efforts resulted in BE3, a single protein consisting of a three-part fusion of the APOBEC1 cytidine deaminase enzyme tethered through a 16-amino acid linker to S. pyogenes dCas9 (A840H), which is covalently linked to UGI through a 4-amino acid linker (1). BE3 and related base editors have now been employed for a wide variety of applications including plant genome editing, in vivo mammalian genome editing, targeted mutagenesis, and knockout studies (2-13). The scope of base editing has been recently expanded by reporting BE3 variants with altered PAM requirements (4), narrowed editing windows (4), reduced off-target editing (10), and small molecule dependence (21).

At some loci, base editors such as BE3 give rise to undesired byproducts in which the target C:G base pair is converted into a G:C or A:T base pair, rather than the desired T:A product (2, 3, 6-8). Here we illuminate determinants of base editing product purity, and establish that UNG activity is required for the formation of undesired byproducts. It has been determined that blocking UNG access to the uracil intermediate is especially crucial for target loci in which a single C is within the editing window in order to minimize undesired products. Fourth-generation base editors, BE4 and SaBE4, that perform base editing with higher efficiency and greatly improved product purity compared to previously described base editors including BE3 were engineered.

Results

UNG Activity is Required for Byproduct Formation

Undesired base editing byproducts may arise during base excision repair due to the formation and error-prone resolution of abasic sites within the uracil-containing DNA strand. To determine if the product purity of base editing in cells lacking uracile N-glycosylase (UNG) improves, HAP1 cells (a haploid human cell line) and HAP1 UNG⁻ cells were nucelofected with plasmids encoding BE3 and sgRNAs targeting the EMX1, FANCF, HEK2, HEK3, HEK4, or RNF2 loci (see FIG. 135B for target sequences). Three days post-nucleofection, genomic DNA was extracted and the target loci were amplified by PCR and analyzed by high-throughput DNA sequencing (HTS). Base editing product purity is defined as the percent of edited sequencing reads (reads in which the target C has been converted to A, G, or T) in which the target C is edited to a T. The base editing product purity of BE3-treated HAP1 cells averaged 68±6% (mean±S.D. for n=3 biological replicates) across 12 target Cs in the six loci. In HAP1 UNG cells, all 12 target Cs tested were base edited with product purities >98% (FIG. 135A). In addition, indel frequencies at all six tested loci decreased 7- to 100-fold upon UNG knockout (FIG. 135C). These data strongly implicate UNG activity as necessary for undesired product formation during base editing, consistent with a model in which abasic site formation and subsequent base excision repair with error-prone polymerases leads to randomization of the target nucleotide and occasional strand breaks that result in indels.

Targets with Multiple Editable Cs Exhibit Higher Product Purity

Base editing efficiency by BE3 can be lower for some (but not all) target Cs that are immediately downstream of a G (1), consistent with the known sequence preference of APOBEC1 (22) (FIG. 136A). In an effort to efficiently edit such targets, BE3 variants in which replaced the APOBEC1 deaminase was replaced with CDA1 (to generate CDA1-BE3), AID (to generate AID-BE3), or APOBEC3G (to generate APOBEC3G-BE3), three single-stranded DNA-specific cytidine deaminase enzymes with different sequence preferences, were generated (23). HEK293T cells were transfected with plasmids encoding these BE3 variants and sgRNAs targeting the EMX1, FANCF, HEK2, HEK3, HEK4, or RNF2 loci. Three days post-transfection, genomic DNA was extracted and the target loci were amplified by PCR and assessed for base editing using HTS. More efficient editing of target Cs that immediately follow a G was observed with CDA1-BE3 and AID-BE3 compared to BE3 (FIG. 136A, FIGS. 140A-D, and FIGS. 146-151). In general, CDA1-BE3 and AID-BE3 exhibited lower editing efficiencies than BE3 at target Cs that do not follow a G (FIGS. 140A-D). In contrast, APOBEC3G-BE3 exhibited unpredictable sequence preferences, with overall lower yields of C-to-T editing compared to BE3. These findings suggest that CDA1-BE3 and AID-BE3 may offer higher editing efficiencies over BE3 for some target 5'-GC-3' sequences.

While analyzing these data, it was noted that the product purities of CDA1-BE3 and AID-BE3 were typically higher than those of BE3 at those sites for which CDA1-BE3 and AID-BE3 edited more Cs than BE3 (FIGS. 136A-D). For example, at the HEK4 locus, BE3 edits only a single C efficiently (the C not preceded by a G) but both CDA1-BE3 and AID-BE3 edit three Cs (FIGS. 140A-C). The product purity of BE3 at this locus is 50±7% (mean±S.D. for n=3 biological replicates), while the product purity of CDA1-BE3 and AID-BE3 are 97±2% and 93±2%, respectively. Moreover, EMX1 and FANCF, edited by BE3 with product purities of 84±3% and 91±2%, respectively, contain multiple Cs that are edited with comparable efficiency (Figure S2), while HEK2 and RNF2, edited by BE3 with much lower product purities of 28±3% and 64±3%, respectively, contain multiple Cs that are edited with unequal efficiencies (FIGS. 141A-C). CDA1-BE3 and AID-BE3, which edit both Cs within the HEK2 locus with comparable efficiencies, exhibit much higher product purities at this locus (85±5% and 81±4%, respectively) (FIGS. 136A-D and FIG. 140C). The possibility that at the HEK2 and RNF2 sites the multiple Cs are initially converted to Us by BE3 with comparable efficiency and then processed with different efficiencies by DNA repair systems was ruled out. Given this, similar product distributions would be expected when these sites were treated with BE3 versus CDA1-BE3 or AID-BE3, rather than the different product distributions observed (FIG. 136B and FIGS. 146-151). Instead, an isolated G:U may be more readily processed by UNG than clusters of G:U lesions. It is possible that the processivity of the cytidine deaminase domain in BE3 (1, 24) may increase the residence time of BE3 at loci containing multiple editable Cs, thereby blocking access by UNG more effectively than at loci containing a single editable C.

The relationship between product purity, the number of edited Cs in individual sequencing reads, and UNG activity was further analyzed. To reveal the fate of base edited DNA in the absence of explicit UNG inhibition, the UGI component of BE3 was removed to generate BE3B. HEK293T cells were transfected with plasmids encoding BE3 or BE3B and sgRNAs targeting the EMX1, FANCF, HEK2, HEK3, HEK4, or RNF2 loci. As expected given the role of UNG in diversifying base editing outcomes established above, the product purities at all target Cs greatly decreased in BE3B-treated DNA compared with BE3-treated DNA, with the fraction of editing products containing non-Ts increasing by an average of 1.8±0.4-fold (FIG. 142B).

Individual DNA sequencing reads from HEK293T cells treated with sgRNAs targeting the multi-C sites HEK2, HEK3, and RNF2 and either BE3 or BE3B were analyzed. For each site, the primary target C was designated as the nucleotide modified most efficiently. Across all three sites, an average of 80±10% of sequencing reads that contained an undesired C to non-T edit of the primary target C exhibited only that single base editing event (FIGS. 142A-D and FIG. 143). In contrast, across the same three multi-C sites, a much lower average of 32±4% of sequencing reads containing a clean C-to-T edit of the primary target C exhibited only that single clean base editing event (FIGS. 142A-D and FIG. 143). In addition, the distribution of products for BE3B-treated HEK4 DNA, a site that contains only one C within the editing window, roughly follows the ratio of 1:3:1 for A:G:T (FIG. 143D). These observations collectively indicate that when a single cytidine in a given target is converted to U in the absence of UGI, it is processed efficiently by UNG-initiated BER to give a mixture of products.

These data are consistent with a model in which clustered G:U mismatches are processed differently than isolated G:U mismatches, and are more likely to produce clean C-to-T edits. When only a single C-to-T editing event is desired, the above observations suggest that UNG inhibition is critical to minimize undesired byproducts. However, when performing targeted random mutagenesis using dCas9-deaminase fusions, such as with TAM(8) and CRISPR-X(2), the above observations suggest that target sites with only a single editable C will maximize product mixtures.

Optimization of BE3 Architecture for Improved Product Purity

The UGI component of BE3 was replaced with a single-stranded DNA binding (SSB) protein to yield SSB-BE3, such that SSB may block the uracil-containing ssDNA portion of the R-loop from being accessed by UNG. Large decreases in base editing efficiency by SSB-BE3 were observed, with all seven Cs across the four sites exhibiting an average of only 1.9±0.5% C-to-T conversion (FIG. 137C).

Since the relative positioning of APOBEC, UGI, and UNG during steps that determine base editing outcomes are not known, UGI was relocated to the N-terminus of BE3 (N-UGI-BE3) in an effort to improve UNG inhibition. Moving UGI to the N-terminus of BE3 resulted in an average decrease in C-to-T editing percentages across all seven tested target Cs of 2.3±0.6-fold compared to BE3 (FIG. 137C), and a decrease in overall product purity at all four sites compared to BE3 averaging 2.2±0.5-fold (FIG. 137B).

In contrast, appending an additional copy of UGI to the C-terminus of BE3 (BE3-2×UGI) resulted in large increases in product purities relative to BE3 and C-to-T editing percentages comparable to those of BE3. Non-T editing products decreased an average of 2.2±0.8-fold across the four loci tested (FIG. 137B). These observations suggest that addition of a second copy of UGI substantially decreases the access of UNG to the G:U base editing intermediate, thereby greatly improving product purity.

Because the above experiments also revealed the sensitivity of base editing outcomes to the architecture of the components, next we optimized the linkers between BE3 components to further increase product purities and editing efficiencies. We varied the rAPOBEC1-dCas9(A840H) linker from 16 amino acids (BE3) to 32 amino acids (BE3C) and the dCas9(A840H)-UGI linker from 4 (BE3) to 9 (BE3D) to 16 amino acids (BE3E, FIG. 138A). Non-T product formation on average decreased 1.3±0.1-fold when the dCas9(A840H)-UGI linker was nine amino acid residues in length (BE3D) instead of four amino acids (BE3) (FIG. 138D), with no apparent differences in C-to-T editing efficiencies (FIG. 138C). Increasing the rAPOBEC1-dCas9 (A840H) linker from 16 amino acids (BE3) to 32 amino acids (BE3C) elevated C-to-T editing efficiencies an average of 1.2±0.1-fold at the HEK2 locus (FIG. 138C). This locus was previously the most unevenly edited multi-C site tested (FIGS. 141A-C), and extending this linker led to a reduction in preferential editing of C6 over C4 (the ratio of the percentage of sequencing reads that are edited at C6 to that of C4) from 2.6±0.2-fold to 1.8±0.1-fold. We reasoned that this longer linker may allow the deaminase better access to the ssDNA in the R-loop and result in more uniform deamination when multiple target Cs are present in the base editing window. BE3C also exhibited comparable or improved base editing efficiencies and product purities at the other loci tested (FIGS. 138C-D).

BE4, a C:G to T:a Base Editor with Enhanced Efficiency and Product Purity

The base editor construct BE4 was engineered by combining all three improvements—extending the rAPOBEC1-dCas9 linker to 32 amino acids, extending the dCas9-UGI linker to 9 amino acids, and appending a second copy of UGI to the C-terminus of the construct with another 9-amino acid linker. Target-AID, an alternative base editor construct reported by Nishida et. al. (9), was also cloned into the same plasmid backbone as BE4. HEK293T cells were transfected with plasmids encoding BE3, BE4, or Target-AID and sgRNAs targeting the EMX1, FANCF, HEK2, HEK3, HEK4, or RNF2 loci. Three days post transfection, genomic DNA was extracted and the target loci were amplified by PCR and analyzed by HTS. An average increase in C-to-T editing efficiencies of 1.5±0.3-fold across all twelve edited Cs for BE4 relative to BE3 was observed (FIG. 139C). Although the average efficiency of C-to-T editing for Target-AID at the same positions analyzed was 1.5±0.5-fold lower than that of BE3 and 2.1±0.5-fold lower than that of BE4, it is important to note that Target-AID, which uses the CDA1 deaminase, appears to have an editing window shifted relative to BE3 and BE4, with optimal editing around positions C3 and C4 (FIG. 139C). This shifted editing window makes comparisons of efficiency and product purity between Target-AID and BE3 or BE4 difficult because a given target C could lie in more optimal or less optimal position within the different editing windows, even when using the same guide RNA.

In addition to greater C-to-T editing efficiency, BE4 also exhibited substantially improved product purities relative to BE3 at all genomic loci tested, with an average decrease in non-T product formation of 2.3±0.3-fold (FIG. 139D). As expected from further impeding base excision repair, which can lead to indels (25), decreases in indel rates averaging 2.3±1.1-fold across all six loci following BE4 treatment compared to BE3 were also observed (FIGS. 144A-C). Taken together, these results indicate that BE4 offers high efficiencies of C-to-T editing, high product purities, and low indel formation rates at all loci tested.

The BE4 improvements were integrated with *S. aureus* Cas9 (26) to generate SaBE4, which replaces the *S. pyogenes* dCas9(A840H) with the smaller *S. aureus* dCas9 (A580N) and can access different targets due to its alternative PAM requirements. HEK293T cells were transfected with plasmids encoding SaBE3 (4) or SaBE4 and sgRNAs targeting the FANCF, HEK3, or HEK4 loci. Consistent with the results comparing BE4 and BE3, we observed an average increase in C-to-T editing efficiencies of 1.4±0.2-fold across all ten edited Cs for SaBE4 relative to SaBE3 (FIG. 145A), with a 1.8±0.5-fold average decrease in undesired non-T editing products (FIG. 145B). These results indicate that the gains in base editing efficiency and product purity that arise from the BE4 enhancements also apply to base editors derived from other Cas9 homologs.

Materials and Methods
Cloning of Plasmids

All plasmids in this study were generated by USER cloning using Phusion U Hot Start polymerase (Thermo Fisher). Deaminase and SSB genes were synthesized as gBlocks Gene Fragments (Integrated DNA Technologies), and Target-AID was obtained from Addgene (plasmid #79620). Protein sequences are listed in the Supplementary Notes.

Cell Culture

HEK293T (ATCC CRL-3216) cells were maintained in Dulbecco's Modified Eagle's Medium plus GlutaMax (ThermoFisher) supplemented with 10% (v/v) fetal bovine serum (FBS), at 37° C. with 5% $CO_2$. HAP1 (Horizon Discovery C631) and HAP1 UNG (Horizon Discovery HZGHC001531c012) were maintained in Iscove's Modified Dulbecco's Medium plus GlutaMax (ThermoFisher Scientific) supplemented with 10% (v/v) fetal bovine serum (FBS), at 37° C. with 5% $CO_2$.

Transfections

HEK293T cells were seeded on 48-well collagen-coated BioCoat plates (Corning) and transfected at approximately 75% confluency. Briefly, 750 ng of BE and 250 ng of sgRNA expression plasmids were transfected using 1.5 µL of LIPOFECTAMINE® 2000 transfection reagent (ThermoFisher Scientific) per well according to the manufacturer's protocol.

HAP1 and HAP1 UNG⁻ cells were nucleofected using the SE Cell Line 4DNucleofector™ X Kit S (Lonza) according to the manufacturer's protocol. Briefly, 4×10⁵ cells were nucleofected with 300 ng of BE and 100 ng of sgRNA expression plasmids using the 4DNucleofector™ program DZ-113.

High-Throughput DNA Sequencing of Genomic DNA Samples

Transfected cells were harvested after 3 days and the genomic DNA was isolated by incubating cells in lysis buffer (10 mM Tris-HCl pH 8.0, 0.05% SDS, 25 µg/mL proteinase K) at 37° C. for 1 hr followed by 80° C. for 30 min. Genomic regions of interest were amplified by PCR with flanking HTS primer pairs as previously described (6, 1). PCR amplification was carried out with Phusion high-fidelity DNA polymerase (ThermoFisher) according to the manufacturer's instructions and as previously described. Purified DNA was amplified by PCR with primers containing sequencing adaptors. The products were gel-purified and quantified using the QuantiT™ PicoGreen dsDNA Assay Kit (ThermoFisher) and KAPA Library Quantification Kit-Illumina (KAPA Biosystems). Samples were sequenced on an Illumina MiSeq as previously described.

Data Analysis

Sequencing reads were automatically demultiplexed using MiSeq Reporter (Illumina), and individual FASTQ files were analyzed with a custom Matlab script as previously described (1). Each read was pairwise aligned to the appropriate reference sequence using the Smith-Waterman algorithm. Base calls with a Q-score below 31 were replaced with Ns and were thus excluded in calculating nucleotide frequencies. This treatment yields an expected MiSeq base-calling error rate of approximately 1 in 1,000. Aligned sequences in which the read and reference sequence contained no gaps were stored in an alignment table from which base frequencies could be tabulated for each locus.

Indel frequencies were quantified with the previously described Matlab script (5, 6, 1). Briefly, sequencing reads were scanned for exact matches to two 10-bp sequences that flank both sides of a window in which indels might occur. If no exact matches were located, the read was excluded from analysis. If the length of this indel window exactly matched the reference sequence the read was classified as not containing an indel. If the indel window was two or more bases longer or shorter than the reference sequence, then the sequencing read was classified as an insertion or deletion, respectively.

In order to evaluate interdependency (linkage disequilibrium) between the base editing outcomes at the multiple target cytidines within an editing window, target site sequences from BE treated cells were analyzed by a custom Python script (Supplementary Note 1). Briefly, sequencing reads were scanned for exact matches to two 7-bp sequences that flank each side of the protospacer. If the intervening region was not exactly 20-bp, then it was excluded further analysis. The protospacer sequences were further filtered into four groups based upon the identity of the nucleotide at the position with the most non-T editing outcomes (the primary target C). For each of these four groups as well as the entire pool, the nucleotide abundance at each of the 20 positions within the protospacer were tallied.

Example 18: Base Editors Comprising an LbCpf1 (Nuclease Dead, Nuclease Active, and Nickase)

As discussed above, nucleic acid programmable DNA binding proteins (napDNAbp) of any of the fusion proteins provided herein may be an LbCpf1 protein. In some embodiments, the LbCpf1 protein is nuclease inactive, nuclease active, or an LbCpf1 nickase. Several constructs of fusion proteins comprising forms of LbCpf1 were tested for their ability to make C to T edits in different target sequences. A schematic representation of the constructs tested is shown in FIG. 152. Construct 10 has a domain arrangement of [Apobec]-[LbCpf1]-[UGI]-[UGI]; construct 11 has a domain arrangement of [Apobec]-[LbCpf1]-[UGI]; construct 12 has a domain arrangement of [UGI]-[Apobec]-[LbCpf1]; construct 13 has a domain arrangement of [Apobec]-[UGI]-[LbCpf1]; construct 14 has a domain arrangement of [LbCpf1]-[UGI]-[Apobec]; construct 15 has a domain arrangement of [LbCpf1]-[Apobec]-[UGI]. For each construct three different LbCpf1 proteins were used (D/N/A, which refers to nuclease dead LbCpf1 (D); LbCpf1 nickase (N) and nuclease active LbCpf1 (A)). For each of these constructs, the linkers linking the domains are shown below, where XTEN refers to the XTEN linker having the sequence SGSETPGTSESATPES (SEQ ID NO: 604), and BPNLS refers to the nuclear localization sequence having the sequence KRTADGSEFEPKKKRKV (SEQ ID NO: 740). Constructs are shown from N-terminus (left) to C-terminus (right).

```
Construct 10: Apobec-SGGSSGGSXTENSGGSSGGS-LbCpf1-
              SGGSGGSGGS-UGI-SGGSGGSGGS-UGI-SGGS-
              BPNLS Construct 11: Apobec-SGGSSGGSXTENSGGSSGGS-LbCpf1-
              SGGSGGSGGS-UGI-SGGS-BPNLS Construct 12: UGI-SGGSGGSGGS-Apobec-SGGSSGGSXTENSG
              GSSGGS-LbCpf1-SGGS-BPNLS Construct 13: Apobec-SGGSGGSGGS-UGI-SGGSSGGSXTENSG
              GSSGGS-LbCpf1-SGGS-BPNLS Construct 14: LbCpf1-SGGSGGSGGS-UGI-SGGSGGSGGS-
              Apobec-SGGS-BPNLS Construct 15: LbCpf1-SGGSGGSGGS-Apobec-SGGSGGSGGS-
              UGI-SGGS-BPNLS
```

The common guide backbone (sgRNA) used in the experiments is GTAATTTCTACTAAGTGTAGAT (SEQ ID NO: 741)[guide sequence]TTTTTTT, wherein each of the Ts of SEQ ID NO: 741 are uracil (U), and where the guide sequence that targets the construct to a specific nucleotide sequence is shown between brackets. In some embodiments, any of the constructs provided herein are complexed with a sgRNA that comprises the backbone sequence of GTAATTTCTACTAAGTGTAGAT(SEQ ID NO: 741), wherein each of the Ts of SEQ ID NO: 741 are uracil (U). In some embodiments, any of the guide RNAs provided herein comprise a guide sequence comprising 14, 15, 16, 17, 18, 19, 20, 21, 22, 23, 24, 25, 26, 27, 28, 29, or 30 nucleotides that are perfectly complementary to a sequence, e.g., a target DNA sequence. In the experiments performed, the guide sequences tested are shown below:

```
EMX23:   TACTTTGTCCTCCGGTTCTGGAA   (SEQ ID NO: 742)
EMX20:   TACTTTGTCCTCCGGTTCTG      (SEQ ID NO: 743)
EMX19:   TACTTTGTCCTCCGGTTCT       (SEQ ID NO: 744)
EMX18:   TACTTTGTCCTCCGGTTC        (SEQ ID NO: 745)
EMX17:   TACTTTGTCCTCCGGTT         (SEQ ID NO: 746)
Hek2_23: CAGCCCGCTGGCCCTGTAAAGGA   (SEQ ID NO: 747)
Hek2_20: CAGCCCGCTGGCCCTGTAAA      (SEQ ID NO: 748)
Hek2_19: CAGCCCGCTGGCCCTGTAA       (SEQ ID NO: 749)
Hek2_18: CAGCCCGCTGGCCCTGTA        (SEQ ID NO: 750)
Hek2_17: CAGCCCGCTGGCCCTGT         (SEQ ID NO: 751)
```

The data demonstrating the C to T base pair editing percentage using various constructs and target sequences is shown in FIGS. 153-159, and the editing percentage values (after adjustment based on indel count), and the percentage of indels for the experiments are shown in FIGS. 160-166.

Supplementary Sequences

Amino Acid Sequences of CDA1-BE3, AID-BE3, BE4, and SaBE4 fusion proteins. CDA1-XTEN-dCas9-UGI-NLS primary sequence (CDA1-BE3):

(SEQ ID NO: 165)
*MTDAEYVRIHEKLDIYTFKKQFFNNKKSVSHRCYVLFELKRRGERRACFW*
*GYAVNKPQSGTERGIHAEIFSIRKVEEYLRDNPGQFTINWYSSWSPCADC*
*AEKILEWYNQELRGNGHTLKIWACKLYYEKNARNQIGLWNLRDNGVGLNV*
*MVSEHYQCCRKIFIQSSHNQLNENRWLEKTLKRAEKRRSELSIMIQVKIL*
*HTTKSPAV*SGSETPGTSESATPES*DKKYSIGLAIGTNSVGWAVITDEYKV
PSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVA
YHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIK
PILEKMDGTEELLVKLNREDLLRKQRTFDNGSIPHQIHLGELHAILRRQE
DFYPFLKDNREKIEKILTFRIPYYVGPLARGNSRFAWMTRKSEETITPWN
FEEVVDKGASAQSFIERMTNFDKNLPNEKVLPKHSLLYEYFTVYNELTKV
KYVTEGMRKPAFLSGEQKKAIVDLLFKTNRKVTVKQLKEDYFKKIECFDS
VETSGVEDRFNASLGTYHDLLKIIKDKDFLDNEENEDILEDIVLTLTLFE
DREMIEERLKTYAHLFDDKVMKQLKRRRYTGWGRLSRKLINGIRDKQSGK
TILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNS
RERMKRIEEGIKELGSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD*SGGS*TNLSD
IIEKETGKQLVIQESILMLPEEVEEVIGNKPESDILVHTAYDESTDENVM
LLTSDAPEYKPWALVIQDSNGENKIKMLSGGS*PKKKRKV*

AID-XTEN-dCas9-UGI-NLS Primary Sequence (AID-BE3):

(SEQ ID NO: 166)

*MDSLLMNRRKFLYQFKNVRWAKGRRETYLCYVVKRRDSATSFSLDFGYLR*
*NKNGCHVELLFLRYISDWDLDPGRCYRVTWFTSWSPCYDCARHVADFLRG*
*NPNLSLRIFTARLYFCEDRKAEPEGLRRLHRAGVQIAIMTFKDYFYCWNT*
*FVENHERTFKAWEGLHENSVRLSRQLRRILLPLYEVDDLRDAFRTLGL*SG
SETPGTSESATPESDKKYSIGLAIGTNSVGWAVITDEYKVPSKKFKVLGN
TDRHSIKKNLIGALLFDSGETAEATRLKRTARRRYTRRKNRICYLQEIFS
NEMAKVDDSFFHRLEESFLVEEDKKHERHPIFGNIVDEVAYHEKYPTIYH
LRKKLVDSTDKADLRLIYLALAHMIKFRGHFLIEGDLNPDNSDVDKLFIQ
LVQTYNQLFEENPINASGVDAKAILSARLSKSRRLENLIAQLPGEKKNGL
FGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKA
LVRQQLPEKYKEIFFDQSKNGYAGYIDGGASQEEFYKFIKPILEKMDGTE
ELLVKLNREDLLRKQRTFDNGSIPHQIHLGELHAILRRQEDFYPFLKDNR
EKIEKILTFRIPYYVGPLARGNSRFAWMTRKSEETITPWNFEEVVDKGAS
AQSFIERMTNFDKNLPNEKVLPKHSLLYEYFTVYNELTKVKYVTEGMRKP
AFLSGEQKKAIVDLLFKTNRKVTVKQLKEDYFKKIECFDSVETSGVEDRF
NASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKGI
LQTVKVVDELVKVMGRHKPENIVIEMARENQTTQKGQKNSRERMKRIEEG
IKELGSQILKEHPVENTQLQNEKLYLYYLQNGRDMYVDQELDINRLSDYD
VDHIVPQSFLKDDSIDNKVLTRSDKNRGKSDNVPSEEVVKKMKNYWRQLL
NAKLITQRKFDNLTKAERGGLSELDKAGFIKRQLVETRQITKHVAQILDS
RMNTKYDENDKLIREVKVITLKSKLVSDFRKDFQFYKVREINNYHHAHDA
YLNAVVGTALIKKYPKLESEFVYGDYKVYDVRKMIAKSEQEIGKATAKYF
FYSNIMNFFKTEITLANGEIRKRPLIETNGETGEIVWDKGRDFATVRKVL
SMPQVNIVKKTEVQTGGFSKESILPKRNSDKLIARKKDWDPKKYGGFDSP
TVAYSVLVVAKVEKGKSKKLKSVKELLGITIMERSSFEKNPIDFLEAKGY
KEVKKDLIIKLPKYSLFELENGRKRMLASAGELQKGNELALPSKYVNFLY
LASHYEKLKGSPEDNEQKQLFVEQHKYLDEIIEQISEFSKRVILADANL
DKVLSAYNKHRDKPIREQAENIIHLFTLTNLGAPAAFKYFDTTIDRKRYT
STKEVLDATLIHQSITGLYETRIDLSQLGGDSGGSTNLSDHEKETGKQLV
IQESILMLPEEVEEVIGNKPESDILVHTAYDESTDENVMLLTSDAPEYKP
WALVIQIDSNGENKIKMLSGGSPKKKRKV rAPOBEC1-linker-dCas9-UGI-UGI-NLS Primary Sequence (BE4):

(SEQ ID NO: 167)

*MSSETGPVAVDPTLRRRIEPHEFEVFFDPRELRKETCLLYEINWGGRHSI*
*WRHTSQNTNKHVEVNFIEKFTTERYFCPNTRCSITWFLSWSPCGECSRAI*
*TEFLSRYPHVTLFIYIARLYHHADPRNRQGLRDLISSGVTIQIMTEQESG*
*YCWRNFVNYSPSNEAHWPRYPHLWVRLYVLELYCHLGLPPCLNILRRKQP*
*QLTFFTIALQSCHYQRLPPHILWATGLK*SGGSSGGSSGSETPGTSESATP*
*ESSGGSSGGS*DKKYSIGLAIGTNSVGWAVITDEYKVPSKKFKVLGNTDRH
SIKKNLIGALLFDSGETAEATRLKRTARRRYTRRKNRICYLQEIFSNEMA
KVDDSFFHRLEESFLVEEDKKHERHPIFGNIVDEVAYHEKYPTIYHLRKK
LVDSTDKADLRLIYLALAHMIKFRGHFLIEGDLNPDNSDVDKLFIQLVQT
YNQLFEENPINASGVDAKAILSARLSKSRRLENLIAQLPGEKKNGLFGNL
IALSLGLTPNFKSNFDLAEDAKLQLSKDTYDDDLDNLLAQIGDQYADLFL
AAKNLSDAILLSDILRVNTEITKAPLSASMIKRYDEHHQDLTLLKALVRQ
QLPEKYKEIFFDQSKNGYAGYIDGGASQEEFYKFIKPILEKMDGTEELLV
KLNREDLLRKQRTFDNGSIPHQIHLGELHAILRRQEDFYPFLKDNREKIE
KILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFLS
GEQKKAIVDLLFKTNRKVTVKQLKEDYFKKIECFDSVEISGVEDRFNASL
GTYHDLLKIIKDKDFLDNEENEDILEDIVLTLTLFEDREMIEERLKTYAH
LFDDKVMKQLKRRRYTGWGRLSRKLINGIRDKQSGKTILDFLKSDGFANR
NFMQLIHDDSLTFKEDIQKAQVSGQGDSLHEHIANLAGSPAIKKGILQTV
KVVDELVKVMGRHKPENIVIEMARENQTTQKGQKNSRERMKRIEEGIKEL
GSQILKEHPVENTQLQNEKLYLYYLQNGRDMYVDQELDINRLSDYDVDHI
VPQSFLKDDSIDNKVLTRSDKNRGKSDNVPSEEVVKKMKNYWRQLLNAKL
ITQRKFDNLTKAERGGLSELDKAGFIKRQLVETRQITKHVAQILDSRMNT
KYDENDKLIREVKVITLKSKLVSDFRKDFQFYKVREINNYHHAHDAYLNA
VVGTALIKKYPKLESEFVYGDYKVYDVRKMIAKSEQEIGKATAKYFFYSN
IMNFFKTEITLANGEIRKRPLIETNGETGEIVWDKGRDFATVRKVLSMPQ
VNIVKKTEVQTGGFSKESILPKRNSDKLIARKKDWDPKKYGGFDSPTVAY
SVLVVAKVEKGKSKKLKSVKELLGITIMERSSFEKNPIDFLEAKGYKEVK
KDLIIKLPKYSLFELENGRKRMLASAGELQKGNELALPSKYVNFLYLASH
YEKLKGSPEDNEQKQLFVEQHKYLDEIIEQISEFSKRVILADANLDKVL
SAYNKHRDKPIREQAENIIHLFTLTNLGAPAAFKYFDTTIDRKRYTSTKE
VLDATLIHQSITGLYETRIDLSQLGGDSGGSGGSGGSTNLSDITEKETGK
QLVICIESILMLPEEVEEVIGNKPESDILVHTAYDESTDENVMLLTSDAP
EYKPWALVICIDSNGENKIKMLSGGSGGSGGS *TNLSDIIEKETGKQLVIQ*
*ESILMLPEEVEEVIGNKPESDILVHTAYDESTDENVMLLTSDAPEYKPWAL*
*VIQDSNGENKIKML*SGGSPKKKRK rAPOBEC1-linker-SaCas9d-UGI-UGI-NLS Primary Sequence (SaBE4):

(SEQ ID NO: 168)

*MSSETGPVAVDPTLRRRIEPHEFEVFFDPRELRKETCLLYEINWGGRHSI*
*WRHTSQNTNKHVEVNFIEKFTTERYFCPNTRCSITWFLSWSPCGECSRAI*

-continued

TEFLSRYPHVTLFIYIARLYHHADPRNRQGLRDLISSGVTIQIMTEQESG

YCWRNFVNYSPSNEAHWPRYPHLWVRLYVLELYCHLGLPPCLNILRRKQP

QLTFFTIALQSCHYQRLPPHILWATGLKSGGSSGGSSGSETPGTSESATP

ESSGGSSGGSGKRNYILGLAIGITSVGYGIIDYETRDVIDAGVRLFKEAN

VENNEGRRSKRGARRLKRRRRHRIQRVKKLLFDYNLLTDHSELSGINPYE

ARVKGLSQKLSEEEFSAALLHLAKRRGVHNVNEVEEDTGNELSTKEQISR

NSKALEEKYVAELQLERLKKDGEVRGSINRFKTSDYVKEAKQLLKVQKAY

HQLDQSFIDTYIDLLETRRTYYEGPGEGSPFGWKDIKEWYEMLMGHCTYF

PEELRSVKYAYNADLYNALNDLNNLVITRDENEKLEYYEKFQIIENVFKQ

KKKPTLKQIAKEILVNEEDIKGYRVTSTGKPEFTNLKVYHDIKDITARKE

IIENAELLDQIAKILTIYQSSEDIQEELTNLNSELTQEEIEQISNLKGYT

GTHNLSLKAINLILDELWHTNDNQIAIFNRLKLVPKKVDLSQQKEIPTTL

VDDFILSPVVKRSFIQSIKVINAIIKKYGLPNDIIIELAREKNSKDAQKM

INEMQKRNRQTNERIEEIIRTTGKENAKYLIEKIKLHDMQEGKCLYSLEA

IPLEDLLNNPFNYEVDHIIPRSVSFDNSFNNKVLVKQEENSKKGNRTPFQ

YLSSSDSKISYETFKKHILNLAKGKGRISKTKKEYLLEERDINRFSVQKD

FINRNLVDTRYATRGLMNLLRSYFRVNNLDVKVKSINGGFTSFLRRKWKF

KKERNKGYKHHAEDALIIANADFIFKEWKKLDKAKKVMENQMFEEKQAES

MPEIETEQEYKEIFITPHQIKHIKDFKDYKYSHRVDKKPNRELINDTLYS

TRKDDKGNTLIVNNLNGLYDKDNDKLKKLINKSPEKLLMYHHDPQTYQKL

KLIMEQYGDEKNPLYKYYEETGNYLTKYSKKDNGPVIKKIKYYGNKLNAH

LDITDDYPNSRNKVVKLSLPKYRFDVYLDNGVYKFVTVKNLDVIKKENYY

EVNSKCYEEAKKLKKISNQAEFIASFYNNDLIKINGELYRVIGVNNDLLN

RIEVNMIDITYREYLENMNDKRPPRIIKTIASKTQSIKKYSTDILGNLYE

VKSKKHPQIIKKGGSPKKKRKVSSDYKDHDGDYKDHDIDYKDDDDKSGGS

GGSGGSTNLSDHEKETGKQLVIQESILMLPEEVEEVIGNKPESDILVHTA

YDESTDENVMLLTSDAPEYKPWALVICIDSNGENKIKMLSGGSGGSGGS

TNLSDIIEKETGKQLVIQESILMIPEEVEEVIGNKPESDILVHTAYDE

STDENVMLITSDAPEYKPWALVIQDSNGENKIKMLSGGSPKKKRKV

References for Example 17

1. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
2. G. T. Hess et al., Directed evolution using dCas9-targeted somatic hypermutation in mammalian cells. Nat Methods 13, 1036-1042 (2016).
3. K. Kim et al., Highly efficient RNA-guided base editing in mouse embryos. Nat Biotechnol 35, 435-437 (2017).
4. Y. B. Kim et al., Increasing the genome-targeting scope and precision of base editing with engineered Cas9-cytidine deaminase fusions. Nat Biotechnol 35, 371-376 (2017).
5. C. Kuscu et al., CRISPR-STOP: gene silencing through base-editing-induced nonsense mutations. Nat Meth advance online publication, (2017).
6. J. Li, Y. Sun, J. Du, Y. Zhao, L. Xia, Generation of Targeted Point Mutations in Rice by a Modified CRISPR/Cas9 System. Mol Plant 10, 526-529 (2017).
7. Y. Lu, J. K. Zhu, Precise Editing of a Target Base in the Rice Genome Using a Modified CRISPR/Cas9 System. Mol Plant 10, 523-525 (2017).
8. Y. Ma et al., Targeted AID-mediated mutagenesis (TAM) enables efficient genomic diversification in mammalian cells. Nat Methods 13, 1029-1035 (2016).
9. K. Nishida et al., Targeted nucleotide editing using hybrid prokaryotic and vertebrate adaptive immune systems. Science 353, (2016).
10. H. A. Rees et al., Improving the DNA specificity and applicability of base editing through protein engineering and protein delivery. Nat Commun 8, 15790 (2017).
11. L. Yang et al., Engineering and optimising deaminase fusions for genome editing. Nat Commun 7, 13330 (2016).
12. Y. Zong et al., Precise base editing in rice, wheat and maize with a Cas9-cytidine deaminase fusion. Nat Biotechnol 35, 438-440 (2017).
13. Z. Shimatani et al., Targeted base editing in rice and tomato using a CRISPR-Cas9 cytidine deaminase fusion. Nat Biotech 35, 441-443 (2017).
14. A. C. Komor, A. H. Badran, D. R. Liu, CRISPR-Based Technologies for the Manipulation of Eukaryotic Genomes. Cell 168, 20-36 (2017).
15. A. J. Davis, D. J. Chen, DNA double strand break repair via non-homologous end-joining. Translational cancer research 2, 130-143 (2013).
16. M. M. Vilenchik, A. G. Knudson, Endogenous DNA double-strand breaks: Production, fidelity of repair, and induction of cancer. Proceedings of the National Academy of Sciences 100, 12871-12876 (2003).
17. F. Liang, M. Han, P. J. Romanienko, M. Jasin, Homology-directed repair is a major doublestrand break repair pathway in mammalian cells. Proceedings of the National Academy of Sciences 95, 5172-5177 (1998).
18. Y. Miyaoka et al., Systematic quantification of HDR and NHEJ reveals effects of locus, nuclease, and cell type on genome-editing. Scientific Reports 6, 23549 (2016).
19. M. M. Jore et al., Structural basis for CRISPR RNA-guided DNA recognition by Cascade. Nat Struct Mol Biol 18, 529-536 (2011).
20. L. H. Pearl, Structure and function in the uracil-DNA glycosylase superfamily. Mutation Research/DNA Repair 460, 165-181 (2000).
21. W. Tang, J. H. Hu, D. R. Liu, Aptazyme-embedded guide RNAs enable ligand-responsive genome editing and transcriptional activation. 8, 15939 (2017).
22. G. Saraconi, F. Severi, C. Sala, G. Mattiuz, S. G. Conticello, The RNA editing enzyme APOBEC1 induces somatic mutations and a compatible mutational signature is present in esophageal adenocarcinomas. Genome Biology 15, 417 (2014).
23. R. M. Kohli et al., Local Sequence Targeting in the AID/APOBEC Family Differentially Impacts Retroviral Restriction and Antibody Diversification. Journal of Biological Chemistry 285, 40956-40964 (2010).
24. L. Chelico, P. Pham, M. F. Goodman, Stochastic properties of processive cytidine DNA deaminases AID and APOBEC3G. Philosophical Transactions of the Royal Society B: Biological Sciences 364, 583-593 (2009).
25. E. A. Kouzminova, A. Kuzminov, Patterns of chromosomal fragmentation due to uracil-DNA incorporation reveal a novel mechanism of replication-dependent double-stranded breaks. Molecular Microbiology 68, 202-215 (2008).
26. F. A. Ran et al., In vivo genome editing using *Staphylococcus aureus* Cas9. Nature 520, 186-191 (2015).
27. F. d. A. di Fagagna, G. R. Weller, A. J. Doherty, S. P. Jackson, The Gam protein of bacteriophage Mu is an orthologue of eukaryotic Ku. EMBO Reports 4, 47-52 (2003).
28. C. Shee et al., Engineered proteins detect spontaneous DNA breakage in human and bacterial cells. eLife 2, e01222 (2013).

EQUIVALENTS AND SCOPE

Those skilled in the art will recognize, or be able to ascertain using no more than routine experimentation, many equivalents of the embodiments described herein. The scope of the present disclosure is not intended to be limited to the above description, but rather is as set forth in the appended claims.

Articles such as "a," "an," and "the" may mean one or more than one unless indicated to the contrary or otherwise evident from the context. Claims or descriptions that include "or" between two or more members of a group are considered satisfied if one, more than one, or all of the group members are present, unless indicated to the contrary or otherwise evident from the context. The disclosure of a group that includes "or" between two or more group members provides embodiments in which exactly one member of the group is present, embodiments in which more than one members of the group are present, and embodiments in which all of the group members are present. For purposes of brevity those embodiments have not been individually spelled out herein, but it will be understood that each of these embodiments is provided herein and may be specifically claimed or disclaimed.

It is to be understood that the invention encompasses all variations, combinations, and permutations in which one or more limitation, element, clause, or descriptive term, from one or more of the claims or from one or more relevant portion of the description, is introduced into another claim. For example, a claim that is dependent on another claim can be modified to include one or more of the limitations found in any other claim that is dependent on the same base claim. Furthermore, where the claims recite a composition, it is to be understood that methods of making or using the composition according to any of the methods of making or using disclosed herein or according to methods known in the art, if any, are included, unless otherwise indicated or unless it would be evident to one of ordinary skill in the art that a contradiction or inconsistency would arise.

Where elements are presented as lists, e.g., in Markush group format, it is to be understood that every possible subgroup of the elements is also disclosed, and that any element or subgroup of elements can be removed from the group. It is also noted that the term "comprising" is intended to be open and permits the inclusion of additional elements or steps. It should be understood that, in general, where an embodiment, product, or method is referred to as comprising particular elements, features, or steps, embodiments, products, or methods that consist, or consist essentially of, such elements, features, or steps, are provided as well. For purposes of brevity those embodiments have not been individually spelled out herein, but it will be understood that each of these embodiments is provided herein and may be specifically claimed or disclaimed.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in some embodiments, to the tenth of the unit of the lower limit of the range, unless the context clearly dictates otherwise. For purposes of brevity, the values in each range have not been individually spelled out herein, but it will be understood that each of these values is provided herein and may be specifically claimed or disclaimed. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range. In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

SEQUENCE LISTING (790 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - DNA, 4212 bp, Artificial Sequence
  Synthetic Polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 4 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 6 - protein, 1368 aa, Streptococcus pyogenes [sequence omitted]

SEQ ID NO: 7 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 8 - protein, 1368 aa, Artificial Sequence; identical to SEQ ID NO: 4
  Synthetic Polypeptide

SEQ ID NO: 9 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 10 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 11 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 12 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 13 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 14 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 15 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 16 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 17 - protein, 1307 aa, Acidaminococcus species
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 18 - protein, 1228 aa, Unknown
  Lachnospiraceae
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 19 - protein, 1307 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGEANLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 20 - protein, 1228 aa, Artificial Sequence
  Synthetic Polypeptide
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGEANLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 21 - protein, 1228 aa, Artificial Sequence
  Synthetic Polypeptide
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 22 - protein, 1305 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKGQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 23 - protein, 1303 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKGKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 24 - protein, 1301 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAGGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 25 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 26 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 27 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 28 - protein, 1050 aa, Unknown
  Marine metagenome
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGS

SEQ ID NO: 29 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 30 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 31 - protein, 1210 aa, Unknown
  Uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 32 - protein, 1368 aa, Artificial Sequence; identical to SEQ ID NO: 7
  Synthetic Polypeptide

SEQ ID NO: 33 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 34 - protein, 1052 aa, Artificial Sequence
  Synthetic Polypeptide
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 35 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 36 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 37 - protein, 1367 aa, Artificial Sequence
  Synthetic Polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 40 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 41 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 42 - protein, 1395 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 43 - protein, 1395 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 44 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 45 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 46 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 47 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 48 - protein, 1612 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 49 - protein, 198 aa, Homo sapiens [sequence omitted]

SEQ ID NO: 50 - protein, 181 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 51 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 52 - protein, 198 aa, Canis lupus familiaris
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 53 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 54 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 55 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 56 - protein, 429 aa, Rattus norvegicus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 57 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 58 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 59 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 60 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 61 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 62 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 63 - protein, 396 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 64 - protein, 227 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 65 - protein, 490 aa, Pan troglodytes
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 66 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 67 - protein, 190 aa, Gorilla gorilla
MNPQIRNPMKAMYPGTFYFQFKNLWEANDRNETWLCFTVEGIKRRSVVSWKTGVFRNQVDSETHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 68 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 69 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 70 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 71 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 72 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 73 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 74 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 75 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 76 - protein, 229 aa, Rattus norvegicus [sequence omitted]

SEQ ID NO: 77 - protein, 60 aa, Homo sapiens
MAQKEEAAVATEAASQNGEDLENLDDPEKLKELIELPPFEIVTGERLPANFFKFQFRNVE

SEQ ID NO: 78 - protein, 164 aa, Mus musculus
YSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 79 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 80 - protein, 60 aa, Bos taurus
MAQKEEAAAAAEPASQNGEEVENLEDPEKLKELIELPPFEIVTGERLPAHYFKFQFRNVE

SEQ ID NO: 81 - protein, 164 aa, Petromyzon marinus
YSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 82 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 83 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 84 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 85 - DNA, 80 bp, Artificial Sequence
  Synthetic Polynucleotide
gtaggtagttaggatgaatggaaggttggtatagtcccgcggatttatttatttaatggatgacctctggatccatggac

SEQ ID NO: 86 - DNA, 80 bp, Artificial Sequence
  Synthetic Polynucleotide
gtaggtagttaggatgaatggaaggttggtatagcttccgcggatttatttatttatggatgacctctggatccatggac

SEQ ID NO: 87 - DNA, 80 bp, Artificial Sequence
  Synthetic Polynucleotide
gtaggtagttaggatgaatggaaggttggtatagccttccgcggatttatttattatggatgacctctggatccatggac

SEQ ID NO: 88 - DNA, 80 bp, Artificial Sequence
  Synthetic Polynucleotide
gtaggtagttaggatgaatggaaggttggtatagccattccgcggatttatttatttggatgacctctggatccatggac

SEQ ID NO: 89 - DNA, 80 bp, Artificial Sequence
  Synthetic Polynucleotide
gtaggtagttaggatgaatggaaggttggtatagcctattccgcggatttatttattggatgacctctggatccatggac

SEQ ID NO: 90 - DNA, 80 bp, Artificial Sequence
  Synthetic Polynucleotide
gtaggtagttaggatgaatggaaggttggtatagccttattccgcggatttatttatggatgacctctggatccatggac

SEQ ID NO: 91 - DNA, 80 bp, Artificial Sequence
  Synthetic Polynucleotide
gtaggtagttaggatgaatggaaggttggtatagccattattccgcggatttattttggatgacctctggatccatggac

SEQ ID NO: 92 - DNA, 80 bp, Artificial Sequence
  Synthetic Polynucleotide
gtaggtagttaggatgaatggaaggttggtatagcctattattccgcggatttatttggatgacctctggatccatggac

SEQ ID NO: 93 - DNA, 80 bp, Artificial Sequence
  Synthetic Polynucleotide
gtaggtagttaggatgaatggaaggttggtatagccattatattccgcggatttattggatgacctctggatccatggac

SEQ ID NO: 94 - DNA, 80 bp, Artificial Sequence
  Synthetic Polynucleotide
gtaggtagttaggatgaatggaaggttggtatagcctattatattccgcggatttatggatgacctctggatccatggac

SEQ ID NO: 95 - DNA, 80 bp, Artificial Sequence
  Synthetic Polynucleotide
gtaggtagttaggatgaatggaaggttggtatagccttattatattccgcggattttggatgacctctggatccatggac

SEQ ID NO: 96 - DNA, 80 bp, Artificial Sequence
  Synthetic Polynucleotide
gtaggtagttaggatgaatggaaggttggtatagccattattatattccgcggatttggatgacctctggatccatggac

SEQ ID NO: 97 - DNA, 80 bp, Artificial Sequence
  Synthetic Polynucleotide
gtaggtagttaggatgaatggaaggttggtatagcctattattatattccgcggattggatgacctctggatccatggac

SEQ ID NO: 98 - DNA, 80 bp, Artificial Sequence
  Synthetic Polynucleotide
gtaggtagttaggatgaatggaaggttggtatagccattattattattaccgcggatggatgacctctggatccatggac

SEQ ID NO: 99 - DNA, 80 bp, Artificial Sequence
  Synthetic Polynucleotide
gtaggtagttaggatgaatggaaggttggtatagccattattattattattaccgctggatgacctctggatccatggac

SEQ ID NO: 100 - DNA, 80 bp, Artificial Sequence
  Synthetic Polynucleotide
gtaggtagttaggatgaatggaaggttggtatagtaatattaatttatttatttaatggatgacctctggatccatggac

SEQ ID NO: 101 - DNA, 80 bp, Artificial Sequence
  Synthetic Polynucleotide
gtaggtagttaggatgaatggaaggttggtgtagattattatctgcggatttattggatgacctctggatccatggacat

SEQ ID NO: 102 - DNA, 80 bp, Artificial Sequence; identical to SEQ ID NO: 91
  Synthetic Polynucleotide

SEQ ID NO: 103 - RNA, 33 nt, Artificial Sequence
  Synthetic Polynucleotide
auuauuccgcggauuuauuuguuuuagagcuag

SEQ ID NO: 104 - RNA, 33 nt, Artificial Sequence
  Synthetic Polynucleotide
cguaggccaggguggucacgguuuuagagcuag

SEQ ID NO: 105 - DNA, 80 bp, Artificial Sequence
  Synthetic Polynucleotide
gtaggtagttaggatgaatggaaggttggtaactatgctgccgcccagtgggactttggaaatacaatgtgtcaactctt

SEQ ID NO: 106 - DNA, 80 bp, Artificial Sequence
  Synthetic Polynucleotide
gtaggtagttaggatgaatggaaggttggtaaaatacaatgtgtcaactcttgacagggctctattttataggcttcttc

SEQ ID NO: 107 - DNA, 80 bp, Artificial Sequence
  Synthetic Polynucleotide
gtaggtagttaggatgaatggaaggttggtattttccatacagtcagtatcaattctggaagaatttccagacattaaag

SEQ ID NO: 108 - DNA, 80 bp, Artificial Sequence
  Synthetic Polynucleotide
gtaggtagttaggatgaatggaaggttggtagcttcggtgtcgaaatgagaagaagaggcacagggctgtgaggcttatc

SEQ ID NO: 109 - DNA, 80 bp, Artificial Sequence
  Synthetic Polynucleotide
gtaggtagttaggatgaatggaaggttggtagtgagcccagaaggggacagtaagaaggaaaaacaggtcagagatggcc

SEQ ID NO: 110 - DNA, 80 bp, Artificial Sequence
  Synthetic Polynucleotide
gtaggtagttaggatgaatggaaggttggtatcctgaacaccttccaggaattctttggcctgaataattgcagtagctc

SEQ ID NO: 111 - DNA, 80 bp, Artificial Sequence
  Synthetic Polynucleotide
gtaggtagttaggatgaatggaaggttggtagacatggaggacgtgcgcggccgcctggtgcagtaccgcggcgaggtgc

SEQ ID NO: 112 - DNA, 80 bp, Artificial Sequence
  Synthetic Polynucleotide
gtaggtagttaggatgaatggaaggttggtactgcagaagcgcctggcagtgtaccaggccggggcccgcgagggcgccg

SEQ ID NO: 113 - DNA, 80 bp, Artificial Sequence
  Synthetic Polynucleotide
gtaggtagttaggatgaatggaaggttggtagccgacaagcagaagaacggcatcaaggtgaacttcaagatccgccaca

SEQ ID NO: 114 - DNA, 80 bp, Artificial Sequence
  Synthetic Polynucleotide
gtaggtagttaggatgaatggaaggttggtaaccactaccagcagaacacccccatcggcgacggccccgtgctgctgcc

SEQ ID NO: 115 - DNA, 81 bp, Artificial Sequence
  Synthetic Polynucleotide
gtaggtagttaggatgaatggaaggttggtacctcgcccttgctcaccatctcgagtcggccgccagtgtgatggatatct

SEQ ID NO: 116 - DNA, 79 bp, Artificial Sequence
  Synthetic Polynucleotide
gtaggtagttaggatgaatggaaggttggtacacgcgtaggccagggtggtcacgagggtgggccagggcacgggcagc

SEQ ID NO: 117 - DNA, 80 bp, Artificial Sequence
  Synthetic Polynucleotide
gtaggtagttaggatgaatggaaggttggtaaagcactgcactccgcaggtcagggtggtcacgagggttggccagggca

SEQ ID NO: 118 - DNA, 80 bp, Artificial Sequence
  Synthetic Polynucleotide
gtaggtagttaggatgaatggaaggttggtacactccgcaggtcagggtggtcacgagggttggccagggcacgggcagg

SEQ ID NO: 119 - DNA, 80 bp, Artificial Sequence
  Synthetic Polynucleotide
gtaggtagttaggatgaatggaaggttggtaggatctcttcttcacggttgcctactggttcaattacttttaaaaatgg

SEQ ID NO: 120 - DNA, 80 bp, Artificial Sequence
  Synthetic Polynucleotide
gtaggtagttaggatgaatggaaggttggtattctcgattgaggatctcttcttcacggttgcctactggttcaattact

SEQ ID NO: 121 - DNA, 80 bp, Artificial Sequence
  Synthetic Polynucleotide
gtaggtagttaggatgaatggaaggttggtaaggagctgtggcagtggcaccagaatggattccagagtccaggtaagac

SEQ ID NO: 122 - DNA, 80 bp, Artificial Sequence
  Synthetic Polynucleotide
gtaggtagttaggatgaatggaaggttggtagtactcctcccggccggcggtatccaggatgtccaacaggcacgtctcc

SEQ ID NO: 123 - DNA, 80 bp, Artificial Sequence
  Synthetic Polynucleotide
gtaggtagttaggatgaatggaaggttggtatgactgcttgcagatggccatggcgcggacgcgggtgccgggcgggggt

SEQ ID NO: 124 - DNA, 80 bp, Artificial Sequence
  Synthetic Polynucleotide
gtaggtagttaggatgaatggaaggttggtactgttacacatgcagttgtagtggatggtggtacagtcagagccaacct

SEQ ID NO: 125 - DNA, 80 bp, Artificial Sequence
  Synthetic Polynucleotide
gtaggtagttaggatgaatggaaggttggtaggaactgtcacacatgtagttgtagtggatggtggtacagtcagagcca

SEQ ID NO: 126 - protein, 1623 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 127 - DNA, 23 bp, Artificial Sequence
  Synthetic Polynucleotide
gagtccgagcagaagaagaaggg

SEQ ID NO: 128 - DNA, 23 bp, Artificial Sequence
  Synthetic Polynucleotide
ggaatcccttctgcagcacctgg

SEQ ID NO: 129 - DNA, 23 bp, Artificial Sequence
  Synthetic Polynucleotide
gaacacaaagcatagactgcggg

SEQ ID NO: 130 - DNA, 23 bp, Artificial Sequence
  Synthetic Polynucleotide
ggcccagactgagcacgtgatgg

SEQ ID NO: 131 - DNA, 23 bp, Artificial Sequence
  Synthetic Polynucleotide
ggcactgcggctggaggtccggg

SEQ ID NO: 132 - DNA, 23 bp, Artificial Sequence
  Synthetic Polynucleotide
gtcatcttagtcattacctgagg

SEQ ID NO: 133 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 134 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 135 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 136 - protein, 209 aa, Artificial Sequence
  Synthetic Polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 137 - protein, 313 aa, Artificial Sequence
  Synthetic Polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 138 - protein, 148 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 139 - protein, 388 aa, Mus musculus
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 140 - protein, 616 aa, Homo sapiens
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 141 - protein, 270 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 142 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 143 - protein, 171 aa, Bacillus subtilis
MLNRVVLVGRLTKDPELRYTPNGAAVATFTLAVNRTFTNQGEREADFINCVTWRRQAENVANFLKKGSLAGVDGRLQTRNYENQQGQRVFVTEVQAESVQFLEPKNGGGSGSGGYNEGNSGGGQYFGGGQNDNPFGGNQNNQRRNQGNSFNDDPFANDGKPIDISDDDLPF

SEQ ID NO: 144 - protein, 199 aa, Streptomyces coelicolor
MAGETVITVVGNLVDDPELRFTPSGAAVAKFRVASTPRTFDRQTNEWKDGESLFLTCSVWRQAAENVAESLQRGMRVIVQGRLKQRSYEDREGVKRTVYELDVDEVGASLRSATAKVTKTSGQGRGGQGGYGGGGGGQGGGGWGGGPGGGQQGGGAPADDPWATGGAPAGGQQGGGGQGGGGWGGGSGGGGGYSDEPPF

SEQ ID NO: 145 - protein, 156 aa, Streptococcus pneumoniae
MINNVVLVGRMTRDAELRYTPSNVAVATFTLAVNRTFKSQNGEREADFINVVMWRQQAENLANWAKKGSLIGVTGRIQTRSYDNQQGQRVYVTEVVAENFQMLESRSVREGHTGGAYSAPTANYSAPTNSVPDFSRNENPFGATNPLDISDDDLPF

SEQ ID NO: 146 - protein, 1196 aa, Human alphaherpesvirus
METKPKTATTIKVPPGPLGYVYARACPSEGIELLALLSARSGDSDVAVAPLVVGLTVESGFEANVAVVVGSRTTGLGGTAVSLKLTPSHYSSSVYVFHGGRHLDPSTQAPNLTRLCERARRHFGFSDYTPRPGDLKHETTGEALCERLGLDPDRALLYLVVTEGFKEAVCINNTFLHLGGSDKVTIGGAEVHRIPVYPLQLFMPDFSRVIAEPFNANHRSIGENFTYPLPFFNRPLNRLLFEAVVGPAAVALRCRNVDAVARAAAHLAFDENHEGAALPADITFTAFEASQGKTPRGGRDGGGKGPAGGFEQRLASVMAGDAALALESIVSMAVFDEPPTDISAWPLFEGQDTAAARANAVGAYLARAAGLVGAMVFSTNSALHLTEVDDAGPADPKDHSKPSFYRFFLVPGTHVAANPQVDREGHVVPGFEGRPTAPLVGGTQEFAGEHLAMLCGFSPALLAKMLFYLERCDGGVIVGRQEMDVFRYVADSNQTDVPCNLCTFDTRHACVHTTLMRLRARHPKFASAARGAIGVFGTMNSMYSDCDVLGNYAAFSALKRADGSETARTIMQETYRAATERVMAELETLQYVDQAVPTAMGRLETIITNREALHTVVNNVRQVVDREVEQLMRNLVEGRNFKFRDGLGEANHAMSLTLDPYACGPCPLLQLLGRRSNLAVYQDLALSQCHGVFAGQSVEGRNFRNQFQPVLRRRVMDMFNNGFLSAKTLTVALSEGAAICAPSLTAGQTAPAESSFEGDVARVTLGFPKELRVKSRVLFAGASANASEAAKARVASLQSAYQKPDKRVDILLGPLGFLLKQFHAAIFPNGKPPGSNQPNPQWFWTALQRNQLPARLLSREDIETIAFIKKFSLDYGAINFINLAPNNVSELAMYYMANQILRYCDHSTYFINTLTAIIAGSRRPPSVQAAAAWSAQGGAGLEAGARALMDAVDAHPGAWTSMFASCNLLRPVMAARPMVVLGLSISKYYGMAGNDRVFQAGNWASLMGGKNACPLLIFDRTRKFVLACPRAGFVCAASSLGGGAHESSLCEQLRGIISEGGAAVASSVFVATVKSLGPRTQQLQIEDWLALLEDEYLSEEMMELTARALERGNGEWSTDAALEVAHEAEALVSQLGNAGEVFNFGDFGCEDDNATPFGGPGAPGPAFAGRKRAFHGDDPFGEGPPDKKGDLTLDML

SEQ ID NO: 147 - protein, 124 aa, Bacillus virus phi29
MENTNIVKATFDTETLEGQIKIFNAQTGGGQSFKNLPDGTIIEANAIAQYKQVSDTYGDAKEETVTTIFAADGSLYSAISKTVAEAASDLIDLVTRHKLETFKVKVVQGTSSKGNVFFSLQLSL

SEQ ID NO: 148 - protein, 162 aa, Burkholderia virus
MASVNKVILVGNLGADPETRYLPSGDAISNIRLATTDRYKDKASGEMKESTEWHRVSFFGRLAEIVDEYLRKGAPVYIEGRIRTRKWQDNAGQDRYTTEIVAEKMQMLGDRRDGGERQQRAPQQQQQRTQRNGYADATGRAQPSQRPAAGGGFDEMDDDIPF

SEQ ID NO: 149 - protein, 1599 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 150 - protein, 1606 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGSGGSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 151 - protein, 1599 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 152 - protein, 1605 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 153 - protein, 1612 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 154 - protein, 772 aa, Artificial Sequence
  Synthetic Polypeptide
MGSSHHHHHHMSSETGPVAVDPTLRRRIEPHEFEVEFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEILANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 155 - protein, 1622 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMFRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 156 - protein, 1709 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYEILFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELYKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGYALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLSDAPEYKPWALVIQDSNGENKIKMLSGGSPKKKRKV

SEQ ID NO: 157 - protein, 1708 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREDIEKILTFRIPYYVGPLARGNSRFAWMTRKSEETITPWNFEEVVDKGASAQSFIERMTNDKNLPNEKVLPKHSLLYEYFTVYNELTKVKYVTEGMRKPAFLSSGEQKKAIVDLLFKTNRKVTVKQLKEDYFKKIECFDSVEISGVEDRFNASLGTYGDLLKIIKDIDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 158 - protein, 1629 aa, Artificial Sequence
  Synthetic Polypeptide
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 159 - protein, 1679 aa, Artificial Sequence
  Synthetic Polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 160 - protein, 1689 aa, Artificial Sequence
  Synthetic Polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 161 - protein, 1655 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 162 - protein, 1665 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 163 - protein, 1665 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 164 - DNA, 246 bp, Artificial Sequence
  Synthetic Polynucleotide
gcggacatggaggacgtgcgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacag

SEQ ID NO: 165 - protein, 1689 aa, Artificial Sequence; identical to SEQ ID NO: 160
  Synthetic Polypeptide

SEQ ID NO: 166 - protein, 1679 aa, Artificial Sequence
  Synthetic Polypeptide
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 167 - protein, 1824 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 168 - protein, 1544 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGGSPKKKRKVSSDYKDHDGDYKDHDIDYKDDDDKSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 169 - DNA, 661 bp, Homo sapiens
catccttggtaccgagctcggatccagccaccatggatagcctcttgatgaatagacgcaagttcctgtatcagtttaaaaacgtgagatgggcaaaaggccgacgagagacatatctgtgctatgtcgttaagcgcagagattcagccaccagtttctctctcgacttcggctacctgcggaacaagaatggttgccatgttgagctcctgttcctgaggtatatcagcgactgggatttggacccagggcggtgctatagggtgacatggtttacctcctggtcaccttgttatgactgcgcgcggcatgttgccgattttctgagagggaaccctaacctgtctctgaggatcttcaccgcgcgactgtacttctgtgaggaccggaaagccgaacccgagggactgagacgcctccacagagcgggtgtgcagattgccataatgacctttaaggactacttctactgctggaacaccttcgtcgaaaatcacgagcggactttcaaggcttgggaaggattgcatgaaaacagcgtcaggctttccaggcagcttcgccgcattcttctcccgttgtacgaggttgatgacctcagagatgcctttagaacactgggactgtaggcggccgctcgattggtttggtgtggctctaa

SEQ ID NO: 170 - DNA, 755 bp, Homo sapiens
catccttggtaccgagctcggatccagccaccatgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcgggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttctgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatgagcggccgctcgattggtttggtgtggctctaa

SEQ ID NO: 171 - DNA, 574 bp, Petromyzon marinus
ctcacagatgctatgtcctgttcgaactcaagagaagaggagagaaaggcgggcctgtttctgggggtacgcggttaataaaccccagtccgggaccgagaggggggattcacgccgagatcttttcaattaggaaggttgaagagtatcttcgcgacaatcccggtcagttcacaattaactggtacagctcctggagcccttgcgctgattgcgccgagaaaatactcgaatggtacaaccaggacttgagaggcaatggccacactctcaagatttgggcttgcaagctttactacgagaagaacgcgagaaatcagattggcttgtggaacctcagggacaacggggtcgggttgaatgttatggtgtccgaacattaccagtgctgtagaaagatcttcattcagtccagtcacaatcagctgaacgagaacagatggctggagaaaacactgaaacgggcagagaaaaggcgctcagagctgagtatcatgatccaggtcaaaatcctgcatacaaccaaaagcccggctgtataagcggccgctcgattggtttggtgtggctctaa

SEQ ID NO: 172 - DNA, 1045 bp, Artificial Sequence
  Synthetic Polynucleotide
catccttggtaccgagctcggatccagccaccatggagctgaagtatcaccctgagatgcggtttttccactggtttagtaagtggcgcaaacttcatcgggatcaggagtatgaagtgacctggtatatctcttggtctccctgcacaaaatgtacacgcgavatggaaacatttctggccgaggatccaaaggtgacgctcacaaatctttgtggcccgcctgtattatttctgggacccggattatcaggaggcacttaggtcattgtgccaaaagcgcgacggaccacgggcgactatgaaaatcatgaattatgacgaattccagcattgctggagtaagtttgtgtacagccagcgggagctgttcgagccctggaacaatcttcccaagtactacatactgcttcacattatgttgggggagatccttcggcactctatggatcctcctaccctttacgtttaaactttaataatgagccttgggttcgcgggcgccatgaaacctatttgtgctacgaggtcgagcggatccataatgatacgtgggtcctgctgaatcagaggagggggtttctgtgtaaccaggctccacataaagatggatttctcgaggggcggcacgccgaactgtgtttccttgatgtgatacctttctggaagctcgaccttgatcaagattacagggtgacgtgtttcacctcctggtcaccctgcttcagttgcgcccaagagatggctaaatttagcagtaagaacaagcatgtgtccctctgtatttttacagccagaatttatgatgaccagggccggtgccaggaggggctgcggacactcgctgaggcgggcgcgaagatcagcataatgacatactccgaattcaaacactgttgggacacttttgtggaccaccagggctgcccatttcagccgtgggatgggctcgacgaacatagtcaggatctctcaggccggctgcgagccatattgcagaaccaggagaattaggcggccgctcgattggtttggtgtggctctaa

SEQ ID NO: 173 - DNA, 785 bp, Escherichia coli
ggccggggattctagaaataattttgtttaactttaagaaggagatataccatggatgtcttctgaaaccggtccggttgcggttgacccgaccctgcgtcgtcgtatcgaaccgcacgaattcgaagttttcttcgaccccgcgtgaactgcgtaaagaaacctgcctgctgtacgaaatcaactggggtggtcgtcactctatctggcgtcacacctctcagaacaccaacaaacacgttgaagttaacttcatcgaaaaattcaccaccgaacgttacttctgcccgaacacccgttgctctatcacctggttcctgtcttggtctccgtgcggtgaatgctcctcgtgcgatcaccgaattcctgtctcgttacccgcacgttaccctgttcatctacatcgcgcgtctgtaccaccacgcggacccgcgtaaccgtcagggtctgcgtgacctgatctcttctggtgttaccatccagatcatgaccgaacaggaatctggttactgctggcgtaacttcgttaactactctccgtctaacgaagcgcactggccgcgttacccgcacctgtgggttcgtctgtacgttctggaactgtactgcatcatcctgggtctgccgccgtgcctgaacatcctgcgtcgtaaacagccgcagctgacctcttcaccatcgcgctgcagtcttgccactaccagcgtctgccgccgcacatcctgtgggcgaccggtctgaaaggtggtagtggagggagcggcggttcaatggataagaaatac

SEQ ID NO: 174 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 175 - protein, 1689 aa, Artificial Sequence; identical to SEQ ID NO: 160
  Synthetic Polypeptide

SEQ ID NO: 176 - protein, 1679 aa, Artificial Sequence; identical to SEQ ID NO: 166
  Synthetic Polypeptide

SEQ ID NO: 177 - protein, 1806 aa, Artificial Sequence
  Synthetic Polypeptide
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQENSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 178 - protein, 1709 aa, Artificial Sequence
  Synthetic Polypeptide
MTNLSDIIEKETGKQLVIQESILMLPEEVEEVIGNKPESDILVHTAYDESTDENVMLLTSDAPEYKPWALVIQDSNGENKIKMLGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 179 - protein, 1810 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRQGGGAPAGGNIGGGQPQGGWGQPQQPQGGNQFSGGAQSRPQQSAPAAPSNEPPMDFDDDIPFSGGSPKKKRKV

SEQ ID NO: 180 - protein, 1716 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 181 - protein, 1722 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGSETPGTSESATPESTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 182 - protein, 1726 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 183 - protein, 1797 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 184 - protein, 1825 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 185 - protein, 1719 aa, Artificial Sequence
  Synthetic Polypeptide
MGSSHHHHHHSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 186 - protein, 1719 aa, Artificial Sequence
  Synthetic Polypeptide
MGSSHHHHHHSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 187 - DNA, 22 bp, Artificial Sequence
  Synthetic Polynucleotide
ggtgtttcgtcctttccacaag

SEQ ID NO: 188 - DNA, 55 bp, Artificial Sequence
  Synthetic Polynucleotide
gcttgcagatggccatggcggttttagagctagaaatagcaagttaaaataaggc

SEQ ID NO: 189 - DNA, 55 bp, Artificial Sequence
  Synthetic Polynucleotide
tgtcacacatgtagttgtaggttttagagctagaaatagcaagttaaaataaggc

SEQ ID NO: 190 - DNA, 55 bp, Artificial Sequence
  Synthetic Polynucleotide
gaagcgcctggcagtgtaccgttttagagctagaaatagcaagttaaaataaggc

SEQ ID NO: 191 - DNA, 55 bp, Artificial Sequence
  Synthetic Polynucleotide
gagtccgagcagaagaagaagttttagagctagaaatagcaagttaaaataaggc

SEQ ID NO: 192 - DNA, 55 bp, Artificial Sequence
  Synthetic Polynucleotide
ggaatcccttctgcagcaccgttttagagctagaaatagcaagttaaaataaggc

SEQ ID NO: 193 - DNA, 55 bp, Artificial Sequence
  Synthetic Polynucleotide
gaacacaaagcatagactgcgttttagagctagaaatagcaagttaaaataaggc

SEQ ID NO: 194 - DNA, 56 bp, Artificial Sequence
  Synthetic Polynucleotide
ggcccagactgagcacgtagagttttagagctagaaatagcaagttaaaataaggc

SEQ ID NO: 195 - DNA, 55 bp, Artificial Sequence
  Synthetic Polynucleotide
ggcactgcggctggaggtgggttttagagctagaaatagcaagttaaaataaggc

SEQ ID NO: 196 - DNA, 55 bp, Artificial Sequence
  Synthetic Polynucleotide
gtcatcttagtcattacctggttttagagctagaaatagcaagttaaaataaggc

SEQ ID NO: 197 - DNA, 42 bp, Artificial Sequence
  Synthetic Polynucleotide
attattattattccgcggatttatttatttatttatttattt

SEQ ID NO: 198 - DNA, 40 bp, Artificial Sequence
  Synthetic Polynucleotide
attattattattagctatttatttatttatttatttattt

SEQ ID NO: 199 - DNA, 41 bp, Artificial Sequence
  Synthetic Polynucleotide
attattattattcccggatttatttatttatttatttattt

SEQ ID NO: 200 - DNA, 21 bp, Artificial Sequence
  Synthetic Polynucleotide
aaaaaaagcaccgactcggtg

SEQ ID NO: 201 - DNA, 60 bp, Artificial Sequence
  Synthetic Polynucleotide
taatacgactcactataggccgcggatttatttatttaagttttagagctagaaatagca

SEQ ID NO: 202 - DNA, 60 bp, Artificial Sequence
  Synthetic Polynucleotide
taatacgactcactataggtccgcggatttatttatttagttttagagctagaaatagca

SEQ ID NO: 203 - DNA, 60 bp, Artificial Sequence
  Synthetic Polynucleotide
taatacgactcactataggttccgcggatttatttattagttttagagctagaaatagca

SEQ ID NO: 204 - DNA, 60 bp, Artificial Sequence
  Synthetic Polynucleotide
taatacgactcactataggattccgcggatttatttattgttttagagctagaaatagca

SEQ ID NO: 205 - DNA, 61 bp, Artificial Sequence
  Synthetic Polynucleotide
taatacgactcactataggtattccgcggatttatttatgtttttagagctagaaatagca

SEQ ID NO: 206 - DNA, 60 bp, Artificial Sequence
  Synthetic Polynucleotide
taataacgactcactataggttattccgcggatttatttagtttagagctagaaatagca

SEQ ID NO: 207 - DNA, 60 bp, Artificial Sequence
  Synthetic Polynucleotide
taatacgactcactataggattattccgcggatttatttgttttagagctagaaatagca

SEQ ID NO: 208 - DNA, 60 bp, Artificial Sequence
  Synthetic Polynucleotide
taatacgactcactataggtattattccgcggatttattgttttagagctagaaatagca

SEQ ID NO: 209 - DNA, 60 bp, Artificial Sequence
  Synthetic Polynucleotide
taatacgactcactataggattattatccgcggatttatgttttagagctagaaatagca

SEQ ID NO: 210 - DNA, 60 bp, Artificial Sequence
  Synthetic Polynucleotide
taatacgactcactataggtattatattccgcggatttagttttagagctagaaatagca

SEQ ID NO: 211 - DNA, 60 bp, Artificial Sequence
  Synthetic Polynucleotide
taatacgactcactataggttattatattccgcggatttgttttagagctagaaatagca

SEQ ID NO: 212 - DNA, 60 bp, Artificial Sequence
  Synthetic Polynucleotide
taatacgactcactataggattattatattccgcggattgttttagagctagaaatagca

SEQ ID NO: 213 - DNA, 60 bp, Artificial Sequence
  Synthetic Polynucleotide
taatacgactcactataggtattattatattccgcggatgttttagagctagaaatagca

SEQ ID NO: 214 - DNA, 60 bp, Artificial Sequence
  Synthetic Polynucleotide
taatacgactcactataggattattattattaccgcggagttttagagctagaaatagca

SEQ ID NO: 215 - DNA, 60 bp, Artificial Sequence
  Synthetic Polynucleotide
taatacgactcactataggattattattattattaccgcgttttagagctagaaatagca

SEQ ID NO: 216 - DNA, 60 bp, Artificial Sequence
  Synthetic Polynucleotide
taatacgactcactataggatattaatttatttatttaagttttagagctagaaatagca

SEQ ID NO: 217 - DNA, 60 bp, Artificial Sequence
  Synthetic Polynucleotide
taatacgactcactataggggaggacgtgcgcggccgccgttttagagctagaaatagca

SEQ ID NO: 218 - DNA, 60 bp, Artificial Sequence
  Synthetic Polynucleotide
taatacgactcactataggctgtggcagtggcaccagaagttttagagctagaaatagca

SEQ ID NO: 219 - DNA, 60 bp, Artificial Sequence
  Synthetic Polynucleotide
taatacgactcactatagggaagcgcctggcagtgtaccgttttagagctagaaatagca

SEQ ID NO: 220 - DNA, 60 bp, Artificial Sequence
  Synthetic Polynucleotide
taatacgactcactataggcctcccggccggcggtatccgttttagagctagaaatagca

SEQ ID NO: 221 - DNA, 60 bp, Artificial Sequence
  Synthetic Polynucleotide
taatacgactcactatagggcttgcagatggccatggcggttttagagctagaaatagca

SEQ ID NO: 222 - DNA, 60 bp, Artificial Sequence
  Synthetic Polynucleotide
taatacgactcactataggacacatgcagttgtagtggagttttagagctagaaatagca

SEQ ID NO: 223 - DNA, 60 bp, Artificial Sequence
  Synthetic Polynucleotide
taatacgactcactataggtgtcacacatgtagttgtaggttttagagctagaaatagca

SEQ ID NO: 224 - DNA, 31 bp, Artificial Sequence
  Synthetic Polynucleotide
gtaggtagttaggatgaatggaaggttggta

SEQ ID NO: 225 - DNA, 80 bp, Artificial Sequence
  Synthetic Polynucleotide
gtccatggatccagaggtcatccattaaataaataaatccgcggggctataccaaccttccattcatcctaactacctac

SEQ ID NO: 226 - DNA, 80 bp, Artificial Sequence
  Synthetic Polynucleotide
gtccatggatccagaggtcatccataaataaataaatccgcggaagctataccaaccttccattcatcctaactacctac

SEQ ID NO: 227 - DNA, 80 bp, Artificial Sequence
  Synthetic Polynucleotide
gtccatggatccagaggtcatccataataaataaatccgcggaaggctataccaaccttccattcatcctaactacctac

SEQ ID NO: 228 - DNA, 81 bp, Artificial Sequence
  Synthetic Polynucleotide
gtccatggatccagaggtcatccaaataaataaatccgcggaatggctataccaaccttccattcatcctaaactacctac

SEQ ID NO: 229 - DNA, 80 bp, Artificial Sequence
  Synthetic Polynucleotide
gtccatggatccagaggtcatccaataaataaatccgcggaataggctataccaaccttccattcatcctaactacctac

SEQ ID NO: 230 - DNA, 82 bp, Artificial Sequence
  Synthetic Polynucleotide
gtccatggatccagaggtcatccaataaataaatccgcggaataaggctatatccaaccttccattcatcctaactacctac

SEQ ID NO: 231 - DNA, 79 bp, Artificial Sequence
  Synthetic Polynucleotide
gtccatggatccagaggtcatccaaaataatccgcggaataatggctataccaaccttccattcatcctaactacctac

SEQ ID NO: 232 - DNA, 80 bp, Artificial Sequence
  Synthetic Polynucleotide
gtccatggatccagaggtcatccaaataaatccgcggaataataggctataccaaccttccattcatcctaactacctac

SEQ ID NO: 233 - DNA, 80 bp, Artificial Sequence
  Synthetic Polynucleotide
gtccatggatccagaggtcatccaataaatccgcggataataatggctataccaaccttccattcatcctaactacctac

SEQ ID NO: 234 - DNA, 80 bp, Artificial Sequence
  Synthetic Polynucleotide
gtccatggatccagaggtcatccataaatccgcggaatataataggctataccaaccttccattcatcctaactacctac

SEQ ID NO: 235 - DNA, 80 bp, Artificial Sequence
  Synthetic Polynucleotide
gtccatggatccagaggtcatccaaaatccgcggaatataataaggctataccaaccttccattcatcctaactacctac

SEQ ID NO: 236 - DNA, 80 bp, Artificial Sequence
  Synthetic Polynucleotide
gtccatggatccagaggtcatccaaatccgcggaatataataatggctataccaaccttccattcatcctaactacctac

SEQ ID NO: 237 - DNA, 80 bp, Artificial Sequence
  Synthetic Polynucleotide
gtccatggatccagaggtcatccaatccgcggaatataataataggctataccaaccttccattcatcctaactacctac

SEQ ID NO: 238 - DNA, 80 bp, Artificial Sequence
  Synthetic Polynucleotide
gtccatggatccagaggtcatccatccgcggtaataataataatggctataccaaccttccattcatcctaactacctac

SEQ ID NO: 239 - DNA, 80 bp, Artificial Sequence
  Synthetic Polynucleotide
gtccatggatccagaggtcatccagcggtaataataataataatggctataccaaccttccattcatcctaactacctac

SEQ ID NO: 240 - DNA, 81 bp, Artificial Sequence
  Synthetic Polynucleotide
gtccatggatccagaggtcatccattaaataaataaattaatattactataaccaaccttccattcatcctaactacctac

SEQ ID NO: 241 - DNA, 80 bp, Artificial Sequence
  Synthetic Polynucleotide
gtaggtagttaggatgaatggaaggttggtgtagattattatcugcggatttattggatgacctctggatccatggacat

SEQ ID NO: 242 - DNA, 80 bp, Artificial Sequence
  Synthetic Polynucleotide
gcacctcgccgcggtactgcaccaggcggccgcgcacgtcctccatgtctaccaaccttccattcatcctaactacctac

SEQ ID NO: 243 - DNA, 80 bp, Artificial Sequence
  Synthetic Polynucleotide
cggcgccctcgcgggccccggcctggtacactgccaggcgcttctgcagtaccaaccttccattcatcctaactacctac

SEQ ID NO: 244 - DNA, 80 bp, Artificial Sequence
  Synthetic Polynucleotide
ctcttacctggactctggaatccattctggtgccactgccacagctccttaccaaccttccattcatcctaactacctac

SEQ ID NO: 245 - DNA, 81 bp, Artificial Sequence
  Synthetic Polynucleotide
ggagacgtgcctgttggaacatcctggataccgccggccgggaggagtactaccaaccttccattcatcctaactacctac

SEQ ID NO: 246 - DNA, 80 bp, Artificial Sequence
  Synthetic Polynucleotide
acccccgcccggcacccgcgtccgcgccatggccatctgcaagcagtcataccaaccttccattcatcctaactacctac

SEQ ID NO: 247 - DNA, 80 bp, Artificial Sequence
  Synthetic Polynucleotide
aggttggctctgactgtaccaccatccactacaactgcatgtgtaacagtaccaaggttccattcatcctaactacctac

SEQ ID NO: 248 - DNA, 80 bp, Artificial Sequence
  Synthetic Polynucleotide
tggctctgactgtaccaccatccactacaactacatgtgtgacagttcctaccaaccttccattcatcctaactacctac

SEQ ID NO: 249 - DNA, 60 bp, Artificial Sequence
  Synthetic Polynucleotide
taatacgactcactataggttatttcgtggatttatttagttttagagctagaaatagca

SEQ ID NO: 250 - DNA, 60 bp, Artificial Sequence
  Synthetic Polynucleotide
taatacgactcactataggatatttcgtggatttatttagttttagagctagaaatagca

SEQ ID NO: 251 - DNA, 60 bp, Artificial Sequence
  Synthetic Polynucleotide
taatacgactcactataggctatttcgtggatttatttagttttagagctagaaatagca

SEQ ID NO: 252 - DNA, 60 bp, Artificial Sequence
  Synthetic Polynucleotide
taatacgactcactatagggtatttcgtggatttatttagttttagagctagaaatagca

SEQ ID NO: 253 - DNA, 60 bp, Artificial Sequence
  Synthetic Polynucleotide
taatacgactcactataggtaatttcgtggatttatttagttttagagctagaaatagca

SEQ ID NO: 254 - DNA, 60 bp, Artificial Sequence
  Synthetic Polynucleotide
taatacgactcactataggtcatttcgtggatttatttagttttagagctagaaatagca

SEQ ID NO: 255 - DNA, 60 bp, Artificial Sequence
  Synthetic Polynucleotide
taatacgactcactataggtgatttcgtggatttatttagttttagagctagaaatagca

SEQ ID NO: 256 - DNA, 60 bp, Artificial Sequence
  Synthetic Polynucleotide
taatacgactcactataggttttttcgtggatttatttagttttagagctagaaatagca

SEQ ID NO: 257 - DNA, 60 bp, Artificial Sequence
  Synthetic Polynucleotide
taatacgactcactataggttctttcgtggatttatttagttttagagctagaaatagca

SEQ ID NO: 258 - DNA, 60 bp, Artificial Sequence
  Synthetic Polynucleotide
taatacgactcactataggttgtttcgtggatttatttagttttagagctagaaatagca

SEQ ID NO: 259 - DNA, 60 bp, Artificial Sequence
  Synthetic Polynucleotide
taatacgactcactataggttaattcgtggatttatttagttttagagctagaaatagca

SEQ ID NO: 260 - DNA, 60 bp, Artificial Sequence
  Synthetic Polynucleotide
taatacgactcactataggttacttcgtggatttatttagttttagagctagaaatagca

SEQ ID NO: 261 - DNA, 60 bp, Artificial Sequence
  Synthetic Polynucleotide
taatacgactcactataggttagttcgtggatttatttagttttagagctagaaatagca

SEQ ID NO: 262 - DNA, 60 bp, Artificial Sequence
  Synthetic Polynucleotide
taatacgactcactataggttatatcgtggatttatttagttttagagctagaaatagca

SEQ ID NO: 263 - DNA, 60 bp, Artificial Sequence
  Synthetic Polynucleotide
taatacgactcactataggttatctcgtggatttatttagttttagagctagaaatagca

SEQ ID NO: 264 - DNA, 60 bp, Artificial Sequence
  Synthetic Polynucleotide
taatacgactcactataggttatgtcgtggatttatttagttttagagctagaaatagca

SEQ ID NO: 265 - DNA, 61 bp, Artificial Sequence
  Synthetic Polynucleotide
taatacgactcactataggttattatcgtggatttatttagttttagagctagaaatagca

SEQ ID NO: 266 - DNA, 61 bp, Artificial Sequence
  Synthetic Polynucleotide
taatacgactcactataggttattctcgtggatttatttagttttagagctagaaatagca

SEQ ID NO: 267 - DNA, 61 bp, Artificial Sequence
  Synthetic Polynucleotide
taatacgactcactataggttattgtcgtggatttatttagttttagagctagaaatagca

SEQ ID NO: 268 - DNA, 60 bp, Artificial Sequence
  Synthetic Polynucleotide
taatacgactcactataggttatttcatggatttatttagttttagagctagaaatagca

SEQ ID NO: 269 - DNA, 60 bp, Artificial Sequence
  Synthetic Polynucleotide
taatacgactcactataggttatttcttggatttatttagttttagagctagaaatagca

SEQ ID NO: 270 - DNA, 60 bp, Artificial Sequence
  Synthetic Polynucleotide
taatacgactcactataggttatttcctggatttatttagttttagagctagaaatagca

SEQ ID NO: 271 - DNA, 60 bp, Artificial Sequence
  Synthetic Polynucleotide
taatacgactcactataggttatttcgaggatttatttagttttagagctagaaatagca

SEQ ID NO: 272 - DNA, 60 bp, Artificial Sequence
  Synthetic Polynucleotide
taatacgactcactataggttatttcgcggatttatttagttttagagctagaaatagca

SEQ ID NO: 273 - DNA, 60 bp, Artificial Sequence
  Synthetic Polynucleotide
taatacgactcactataggttatttcggggatttatttagttttagagctagaaatagca

SEQ ID NO: 274 - DNA, 60 bp, Artificial Sequence
  Synthetic Polynucleotide
taatacgactcactataggttatttcgtagatttatttagttttagagctagaaatagca

SEQ ID NO: 275 - DNA, 60 bp, Artificial Sequence
  Synthetic Polynucleotide
taatacgactcactataggttatttcgttgatttatttagttttagagctagaaatagca

SEQ ID NO: 276 - DNA, 60 bp, Artificial Sequence
  Synthetic Polynucleotide
taatacgactcactataggttatttcgtcgatttatttagttttagagctagaaatagca

SEQ ID NO: 277 - DNA, 60 bp, Artificial Sequence
  Synthetic Polynucleotide
taatacgactcactataggttatttcgtgaatttatttagttttagagctagaaatagca

SEQ ID NO: 278 - DNA, 60 bp, Artificial Sequence
  Synthetic Polynucleotide
taatacgactcactataggttatttcgtgtatttatttagttttagagctagaaatagca

SEQ ID NO: 279 - DNA, 60 bp, Artificial Sequence
  Synthetic Polynucleotide
taatacgactcactataggttatttcgtgcatttatttagttttagagctagaaatagca

SEQ ID NO: 280 - DNA, 60 bp, Artificial Sequence
  Synthetic Polynucleotide
taatacgactcactataggttatttcgtggttttatttagttttagagctagaaatagca

SEQ ID NO: 281 - DNA, 60 bp, Artificial Sequence
  Synthetic Polynucleotide
taatacgactcactataggttatttcgtggctttatttagttttagagctagaaatagca

SEQ ID NO: 282 - DNA, 60 bp, Artificial Sequence
  Synthetic Polynucleotide
taatacgactcactataggttatttcgtgggtttatttagttttagagctagaaatagca

SEQ ID NO: 283 - DNA, 60 bp, Artificial Sequence
  Synthetic Polynucleotide
taatacgactcactataggttatttcgtggaattatttagttttagagctagaaatagca

SEQ ID NO: 284 - DNA, 60 bp, Artificial Sequence
  Synthetic Polynucleotide
taatacgactcactataggttatttcgtggacttatttagttttagagctagaaatagca

SEQ ID NO: 285 - DNA, 60 bp, Artificial Sequence
  Synthetic Polynucleotide
taatacgactcactataggttatttcgtggagttatttagttttagagctagaaatagca

SEQ ID NO: 286 - DNA, 60 bp, Artificial Sequence
  Synthetic Polynucleotide
taatacgactcactataggttccccccccgatttatttagttttagagctagaaatagca

SEQ ID NO: 287 - DNA, 60 bp, Artificial Sequence
  Synthetic Polynucleotide
taatacgactcactataggcgcacccgtggatttatttagttttagagctagaaatagca

SEQ ID NO: 288 - DNA, 60 bp, Artificial Sequence
  Synthetic Polynucleotide
taatacgactcactataggctcgcacgtggatttatttagttttagagctagaaatagca

SEQ ID NO: 289 - DNA, 60 bp, Artificial Sequence
  Synthetic Polynucleotide
taatacgactcactataggccctcgcgtggatttatttagttttagagctagaaatagca

SEQ ID NO: 290 - DNA, 60 bp, Artificial Sequence
  Synthetic Polynucleotide
taatacgactcactataggcaccctcgtggatttatttagttttagagctagaaatagca

SEQ ID NO: 291 - DNA, 60 bp, Artificial Sequence
  Synthetic Polynucleotide
taatacgactcactataggtcgcacccgtggatttattagttttagagctagaaatagca

SEQ ID NO: 292 - DNA, 60 bp, Artificial Sequence
  Synthetic Polynucleotide
taatacgactcactataggcctcgcacgtggatttattagttttagagctagaaatagca

SEQ ID NO: 293 - DNA, 60 bp, Artificial Sequence
  Synthetic Polynucleotide
taatacgactcactataggaccctcgcgtggatttattagttttagagctagaaatagca

SEQ ID NO: 294 - DNA, 60 bp, Artificial Sequence
  Synthetic Polynucleotide
taatacgactcactatagggcaccctcgtggatttattagttttagagctagaaatagca

SEQ ID NO: 295 - DNA, 60 bp, Artificial Sequence
  Synthetic Polynucleotide
taatacgactcactatagggagtccgagcagaagaagaagttttagagctagaaatagca

SEQ ID NO: 296 - DNA, 60 bp, Artificial Sequence
  Synthetic Polynucleotide
taatacgactcactataggggaatcccttctgcagcaccgttttagagctagaaatagca

SEQ ID NO: 297 - DNA, 60 bp, Artificial Sequence
  Synthetic Polynucleotide
taatacgactcactatagggaacacaaagcatagactgcgttttagagctagaaatagca

SEQ ID NO: 298 - DNA, 60 bp, Artificial Sequence
  Synthetic Polynucleotide
taatacgactcactataggggcccagactgagcacgtgagttttagagctagaaatagca

SEQ ID NO: 299 - DNA, 60 bp, Artificial Sequence
  Synthetic Polynucleotide
taatacgactcactataggggcactgcggctggaggtgggttttagagctagaaatagca

SEQ ID NO: 300 - DNA, 60 bp, Artificial Sequence
  Synthetic Polynucleotide
taatacgactcactatagggtcatcttagtcattacctggttttagagctagaaatagca

SEQ ID NO: 301 - DNA, 60 bp, Artificial Sequence
  Synthetic Polynucleotide
acgtaaacggccacaagttcttatttcgtggatttatttatggcatcttcttcaaggacg

SEQ ID NO: 302 - DNA, 60 bp, Artificial Sequence
  Synthetic Polynucleotide
acgtaaacggccacaagttcatatttcgtggatttatttatggcatcttcttcaaggacg

SEQ ID NO: 303 - DNA, 60 bp, Artificial Sequence
  Synthetic Polynucleotide
acgtaaacggccacaagttcctatttcgtggatttatttatggcatcttcttcaaggacg

SEQ ID NO: 304 - DNA, 60 bp, Artificial Sequence
  Synthetic Polynucleotide
acgtaaacggccacaagttcgtatttcgtggatttatttatggcatcttcttcaaggacg

SEQ ID NO: 305 - DNA, 60 bp, Artificial Sequence
  Synthetic Polynucleotide
acgtaaacggccacaagttctaatttcgtggatttatttatggcatcttcttcaaggacg

SEQ ID NO: 306 - DNA, 60 bp, Artificial Sequence
  Synthetic Polynucleotide
acgtaaacggccacaagttctcatttcgtggatttatttatggcatcttcttcaaggacg

SEQ ID NO: 307 - DNA, 60 bp, Artificial Sequence
  Synthetic Polynucleotide
acgtaaacggccacaagttctgatttcgtggatttatttatggcatcttcttcaaggacg

SEQ ID NO: 308 - DNA, 60 bp, Artificial Sequence
  Synthetic Polynucleotide
acgtaaacggccacaagttcttttttcgtggatttatttatggcatcttcttcaaggacg

SEQ ID NO: 309 - DNA, 60 bp, Artificial Sequence
  Synthetic Polynucleotide
acgtaaacggccacaagttcttctttcgtggatttatttatggcatcttcttcaaggacg

SEQ ID NO: 310 - DNA, 60 bp, Artificial Sequence
  Synthetic Polynucleotide
acgtaaacggccacaagttcttgtttcgtggatttatttatggcatcttcttcaaggacg

SEQ ID NO: 311 - DNA, 60 bp, Artificial Sequence
  Synthetic Polynucleotide
acgtaaacggccacaagttcttaattcgtggatttatttatggcatcttcttcaaggacg

SEQ ID NO: 312 - DNA, 60 bp, Artificial Sequence
  Synthetic Polynucleotide
acgtaaacggccacaagttcttacttcgtggatttatttatggcatcttcttcaaggacg

SEQ ID NO: 313 - DNA, 60 bp, Artificial Sequence
  Synthetic Polynucleotide
acgtaaacggccacaagttcttagttcgtggatttatttatggcatcttcttcaaggacg

SEQ ID NO: 314 - DNA, 60 bp, Artificial Sequence
  Synthetic Polynucleotide
acgtaaacggccacaagttcttatatcgtggatttatttatggcatcttcttcaaggacg

SEQ ID NO: 315 - DNA, 60 bp, Artificial Sequence
  Synthetic Polynucleotide
acgtaaacggccacaagttcttatctcgtggatttatttatggcatcttcttcaaggacg

SEQ ID NO: 316 - DNA, 60 bp, Artificial Sequence
  Synthetic Polynucleotide
acgtaaacggccacaagttcttatgtcgtggatttatttatggcatcttcttcaaggacg

SEQ ID NO: 317 - DNA, 60 bp, Artificial Sequence
  Synthetic Polynucleotide
acgtaaacggccacaagttcttattacgtggatttatttatggcatcttcttcaaggacg

SEQ ID NO: 318 - DNA, 60 bp, Artificial Sequence
  Synthetic Polynucleotide
acgtaaacggccacaagttcttattccgtggatttatttatggcatcttcttcaaggacg

SEQ ID NO: 319 - DNA, 60 bp, Artificial Sequence
  Synthetic Polynucleotide
acgtaaacggccacaagttcttattgcgtggatttatttatggcatcttcttcaaggacg

SEQ ID NO: 320 - DNA, 60 bp, Artificial Sequence
  Synthetic Polynucleotide
acgtaaacggccacaagttcttatttcatggatttatttatggcatcttcttcaaggacg

SEQ ID NO: 321 - DNA, 60 bp, Artificial Sequence
  Synthetic Polynucleotide
acgtaaacggccacaagttcttatttcttggatttatttatggcatcttcttcaaggacg

SEQ ID NO: 322 - DNA, 60 bp, Artificial Sequence
  Synthetic Polynucleotide
acgtaaacggccacaagttcttatttcctggatttatttatggcatcttcttcaaggacg

SEQ ID NO: 323 - DNA, 60 bp, Artificial Sequence
  Synthetic Polynucleotide
acgtaaacggccacaagttcttatttcgaagatttatttatggcatcttcttcaaggacg

SEQ ID NO: 324 - DNA, 60 bp, Artificial Sequence
  Synthetic Polynucleotide
acgtaaacggccacaagttcttatttcgacgatttatttatggcatcttcttcaaggacg

SEQ ID NO: 325 - DNA, 60 bp, Artificial Sequence
  Synthetic Polynucleotide
acgtaaacggccacaagttcttatttcgaggatttatttatggcatcttcttcaaggacg

SEQ ID NO: 326 - DNA, 60 bp, Artificial Sequence
  Synthetic Polynucleotide
acgtaaacggccacaagttcttatttcgtagatttatttatggcatcttcttcaaggacg

SEQ ID NO: 327 - DNA, 60 bp, Artificial Sequence
  Synthetic Polynucleotide
acgtaaacggccacaagttcttatttcgttgatttatttatggcatcttcttcaaggacg

SEQ ID NO: 328 - DNA, 60 bp, Artificial Sequence
  Synthetic Polynucleotide
acgtaaacggccacaagttcttatttcgtcgatttatttatggcatcttcttcaaggacg

SEQ ID NO: 329 - DNA, 60 bp, Artificial Sequence
  Synthetic Polynucleotide
acgtaaacggccacaagttcttatttcgtgaatttatttatggcatcttcttcaaggacg

SEQ ID NO: 330 - DNA, 60 bp, Artificial Sequence
  Synthetic Polynucleotide
acgtaaacggccacaagttcttatttcgtgtatttatttatggcatcttcttcaaggacg

SEQ ID NO: 331 - DNA, 60 bp, Artificial Sequence
  Synthetic Polynucleotide
acgtaaacggccacaagttcttatttcgtgcatttatttatggcatcttcttcaaggacg

SEQ ID NO: 332 - DNA, 60 bp, Artificial Sequence
  Synthetic Polynucleotide
acgtaaacggccacaagttcttatttcgtggttttatttatggcatcttcttcaaggacg

SEQ ID NO: 333 - DNA, 60 bp, Artificial Sequence
  Synthetic Polynucleotide
acgtaaacggccacaagttcttatttcgtggctttatttatggcatcttcttcaaggacg

SEQ ID NO: 334 - DNA, 60 bp, Artificial Sequence
  Synthetic Polynucleotide
acgtaaacggccacaagttcttatttcgtgggtttatttatggcatcttcttcaaggacg

SEQ ID NO: 335 - DNA, 60 bp, Artificial Sequence
  Synthetic Polynucleotide
acgtaaacggccacaagttcttatttcgtggaattatttatggcatcttcttcaaggacg

SEQ ID NO: 336 - DNA, 60 bp, Artificial Sequence
  Synthetic Polynucleotide
acgtaaacggccacaagttcttatttcgtggacttatttatggcatcttcttcaaggacg

SEQ ID NO: 337 - DNA, 60 bp, Artificial Sequence
  Synthetic Polynucleotide
acgtaaacggccacaagttcttatttcgtggagttatttatggcatcttcttcaaggacg

SEQ ID NO: 338 - DNA, 61 bp, Artificial Sequence
  Synthetic Polynucleotide
acgtaaacggccacaaagtttcgcacccgtggatttatttatggcatcttcttcaaggacg

SEQ ID NO: 339 - DNA, 60 bp, Artificial Sequence
  Synthetic Polynucleotide
acgtaaacggccacaagttcctcgcacgtggatttatttatggcatcttcttcaaggacg

SEQ ID NO: 340 - DNA, 60 bp, Artificial Sequence
  Synthetic Polynucleotide
acgtaaacggccacaagttaccctcgcgtggatttatttatggcatcttcttcaaggacg

SEQ ID NO: 341 - DNA, 60 bp, Artificial Sequence
  Synthetic Polynucleotide
acgtaaacggccacaagttgcaccctcgtggatttatttatggcatcttcttcaaggacg

SEQ ID NO: 342 - DNA, 60 bp, Artificial Sequence
  Synthetic Polynucleotide
acgtaaacggccacaagtattcgcacccgtggatttattatggcatcttcttcaaggacg

SEQ ID NO: 343 - DNA, 60 bp, Artificial Sequence
  Synthetic Polynucleotide
acgtaaacggccacaagtatcctcgcacgtggatttattatggcatcttcttcaaggacg

SEQ ID NO: 344 - DNA, 60 bp, Artificial Sequence
  Synthetic Polynucleotide
acgtaaacggccacaagtataccctcgcgtggatttattatggcatcttcttcaaggacg

SEQ ID NO: 345 - DNA, 60 bp, Artificial Sequence
  Synthetic Polynucleotide
acgtaaacggccacaagtatgcaccctcgtggatttattatggcatcttcttcaaggacg

SEQ ID NO: 346 - DNA, 80 bp, Artificial Sequence
  Synthetic Polynucleotide
gtaggtagttaggatgaatggaaggttggtaggcctgagtccgagcagaagaagaagggctcccatcacatcaaccggtg

SEQ ID NO: 347 - DNA, 80 bp, Artificial Sequence
  Synthetic Polynucleotide
gtaggtagttaggatgaatggaaggttggtactcatggaatcccttctgcagcacctggatcgcttttccgagcttctgg

SEQ ID NO: 348 - DNA, 80 bp, Artificial Sequence
  Synthetic Polynucleotide
gtaggtagttaggatgaatggaaggttggtaaactggaacacaaagcatagactgcggggcgggccagcctgaatagctg

SEQ ID NO: 349 - DNA, 80 bp, Artificial Sequence
  Synthetic Polynucleotide
gtaggtagttaggatgaatggaaggttggtacttggggcccagactgagcacgtgatggcagaggaaaggaagccctgct

SEQ ID NO: 350 - DNA, 80 bp, Artificial Sequence
  Synthetic Polynucleotide
gtaggtagttaggatgaatggaaggttggtaccggtggcactgcggctggaggtgggggttaaagcggagactctggtgc

SEQ ID NO: 351 - DNA, 80 bp, Artificial Sequence
  Synthetic Polynucleotide
gtaggtagttaggatgaatggaaggttggtatggcagtcatcttagtcattacctgaggtgttcgttgtaactcatataa

SEQ ID NO: 352 - DNA, 81 bp, Artificial Sequence
  Synthetic Polynucleotide
gtaggtagttaggatgaatggaaggttggtatggcagtcatcttagtcattaccttgaggtgttcgttgtaactcatataa

SEQ ID NO: 353 - DNA, 53 bp, Artificial Sequence
  Synthetic Polynucleotide
  misc_feature (34)..(37): n is a, c, g, or t
acactctttccctacacgacgctcttccgatctnnnnacgtaaacggccacaa

SEQ ID NO: 354 - DNA, 47 bp, Artificial Sequence
  Synthetic Polynucleotide
tggagttcagacgtgtgctcttccgatctcgtccttgaagaagatgc

SEQ ID NO: 355 - DNA, 60 bp, Artificial Sequence
  Synthetic Polynucleotide
  misc_feature (34)..(37): n is a, c, g, or t
acactctttccctacacgacgctcttccgatctnnnngtaggtagttaggatgaatggaa

SEQ ID NO: 356 - DNA, 47 bp, Artificial Sequence
  Synthetic Polynucleotide
tggagttcagacgtgtgctcttccgatctcaccggttgatgtgatgg

SEQ ID NO: 357 - DNA, 47 bp, Artificial Sequence
  Synthetic Polynucleotide
tggagttcagacgtgtgctcttccgatctccagaagctcggaaaagc

SEQ ID NO: 358 - DNA, 46 bp, Artificial Sequence
  Synthetic Polynucleotide
tggagttcagacgtgtgctcttccgatctcagctattcaggctggc

SEQ ID NO: 359 - DNA, 45 bp, Artificial Sequence
  Synthetic Polynucleotide
tggagttcagacgtgtgctcttccgatctagcagggcttcctttc

SEQ ID NO: 360 - DNA, 44 bp, Artificial Sequence
  Synthetic Polynucleotide
tggagttcagacgtgtgctcttccgatctgcaccagagtctccg

SEQ ID NO: 361 - DNA, 52 bp, Artificial Sequence
  Synthetic Polynucleotide
tggagttcagacgtgtgctcttccgatctttatatgagttacaacgaacacc

SEQ ID NO: 362 - DNA, 57 bp, Artificial Sequence
  Synthetic Polynucleotide
  misc_feature (34)..(37): n is a, c, g, or t
acactctttccctacacgacgctcttccgatctnnnncagctcagcctgagtgttga

SEQ ID NO: 363 - DNA, 48 bp, Artificial Sequence
  Synthetic Polynucleotide
tggagttcagacgtgtgctcttccgatctctcgtgggtttgtggttgc

SEQ ID NO: 364 - DNA, 57 bp, Artificial Sequence
  Synthetic Polynucleotide
  misc_feature (34)..(37): n is a, c, g, or t
acactctttccctacacgacgctcttccgatctnnnncattgcagagaggcgtatca

SEQ ID NO: 365 - DNA, 47 bp, Artificial Sequence
  Synthetic Polynucleotide
tggagttcagacgtgtgctcttccgatctggggtcccaggtgctgac

SEQ ID NO: 366 - DNA, 57 bp, Artificial Sequence
  Synthetic Polynucleotide
  misc_feature (34)..(37): n is a, c, g, or t
acactctttccctacacgacgctcttccgatctnnnnccagccccatctgtcaaact

SEQ ID NO: 367 - DNA, 53 bp, Artificial Sequence
  Synthetic Polynucleotide
tggagttcagacgtgtgctcttccgatcttgaatggattcttggaaacaatga

SEQ ID NO: 368 - DNA, 57 bp, Artificial Sequence
  Synthetic Polynucleotide
  misc_feature (34)..(37): n is a, c, g, or t
acactctttccctacacgacgctcttccgatctnnnnatgtgggctgcctagaaagg

SEQ ID NO: 369 - DNA, 49 bp, Artificial Sequence
  Synthetic Polynucleotide
tggagttcagacgtgtgctcttccgatctcccagccaaacttgtcaacc

SEQ ID NO: 370 - DNA, 57 bp, Artificial Sequence
  Synthetic Polynucleotide
  misc_feature (34)..(37): n is a, c, g, or t
acactctttccctacacgacgctcttccgatctnnnngaacccaggtagccagagac

SEQ ID NO: 371 - DNA, 49 bp, Artificial Sequence
  Synthetic Polynucleotide
tggagttcagacgtgtgctcttccgatcttcctttcaacccgaacggag

SEQ ID NO: 372 - DNA, 60 bp, Artificial Sequence
  Synthetic Polynucleotide
  misc_feature (34)..(37): n is a, c, g, or t
acactctttccctacacgacgctcttccgatctnnnnctcttctttatttccagcaatgt

SEQ ID NO: 373 - DNA, 56 bp, Artificial Sequence
  Synthetic Polynucleotide
tggagttcagacgtgtgctcttccgatctgttttcatgttctaaaaatgtatccca

SEQ ID NO: 374 - DNA, 57 bp, Artificial Sequence
  Synthetic Polynucleotide
  misc_feature (34)..(37): n is a, c, g, or t
acactctttccctacacgacgctcttccgatctnnnntacagtactcccctgccctc

SEQ ID NO: 375 - DNA, 49 bp, Artificial Sequence
  Synthetic Polynucleotide
tggagttcagacgtgtgctcttccgatctgctgctcaccatcgctatct

SEQ ID NO: 376 - DNA, 57 bp, Artificial Sequence
  Synthetic Polynucleotide
  misc_feature (34)..(37): n is a, c, g, or t
acactctttccctacacgacgctcttccgatctnnnncctcatcttgggcctgtgtt

SEQ ID NO: 377 - DNA, 49 bp, Artificial Sequence
  Synthetic Polynucleotide
tggagttcagacgtgtgctcttccgatctaaatcggtaagaggtgggcc

SEQ ID NO: 378 - DNA, 55 bp, Artificial Sequence
  Synthetic Polynucleotide
  misc_feature (34)..(37): n is a, c, g, or t
acactctttccctacacgacgctcttccgatctnnnngcggacatggaggacgtg

SEQ ID NO: 379 - DNA, 47 bp, Artificial Sequence
  Synthetic Polynucleotide
tggagttcagacgtgtgctcttccgatctctgttccaccaggggccc

SEQ ID NO: 380 - DNA, 58 bp, Artificial Sequence
  Synthetic Polynucleotide
  misc_feature (34)..(37): n is a, c, g, or t
acactctttccctacacgacgctcttccgatctnnnntgcccaatcattgatgctttt

SEQ ID NO: 381 - DNA, 56 bp, Artificial Sequence
  Synthetic Polynucleotide
tggagttcagacgtgtgctcttccgatctagaaacatttaccatagactatcacct

SEQ ID NO: 382 - DNA, 59 bp, Artificial Sequence
  Synthetic Polynucleotide
  misc_feature (34)..(37): n is a, c, g, or t
acactctttccctacacgacgctcttccgatctnnnnagtagcctctttctcaatgtgc

SEQ ID NO: 383 - DNA, 50 bp, Artificial Sequence
  Synthetic Polynucleotide
tggagttcagacgtgtgctcttccgatctgctttcacaaggatgcagtct

SEQ ID NO: 384 - DNA, 56 bp, Artificial Sequence
  Synthetic Polynucleotide
  misc_feature (34)..(37): n is a, c, g, or t
acactctttccctacacgacgctcttccgatctnnnngagctagactccgagggga

SEQ ID NO: 385 - DNA, 49 bp, Artificial Sequence
  Synthetic Polynucleotide
tggagttcagacgtgtgctcttccgatcttcctcgtcctgctctcactt

SEQ ID NO: 386 - DNA, 58 bp, Artificial Sequence
  Synthetic Polynucleotide
  misc_feature (34)..(37): n is a, c, g, or t
acactctttccctacacgacgctcttccgatctnnnnagaggctgaagaggaagacca

SEQ ID NO: 387 - DNA, 49 bp, Artificial Sequence
  Synthetic Polynucleotide
tggagttcagacgtgtgctcttccgatctggcccagctgtgcattctat

SEQ ID NO: 388 - DNA, 56 bp, Artificial Sequence
  Synthetic Polynucleotide
  misc_feature (34)..(37): n is a, c, g, or t
acactctttccctacacgacgctcttccgatctnnnnccaagagggccaagtcctg

SEQ ID NO: 389 - DNA, 47 bp, Artificial Sequence
  Synthetic Polynucleotide
tggagttcagacgtgtgctcttccgatctcagcgaggagtgacagcc

SEQ ID NO: 390 - DNA, 57 bp, Artificial Sequence
  Synthetic Polynucleotide
  misc_feature (34)..(37): n is a, c, g, or t
acactctttccctacacgacgctcttccgatctnnnncactccacctgatctcgggg

SEQ ID NO: 391 - DNA, 47 bp, Artificial Sequence
  Synthetic Polynucleotide
tggagttcagacgtgtgctcttccgatctcgaggagggagggagcag

SEQ ID NO: 392 - DNA, 57 bp, Artificial Sequence
  Synthetic Polynucleotide
  misc_feature (34)..(37): n is a, c, g, or t
acactctttccctacacgacgctcttccgatctnnnnaccacaaatgcccaagagac

SEQ ID NO: 393 - DNA, 47 bp, Artificial Sequence
  Synthetic Polynucleotide
tggagttcagacgtgtgctcttccgatctgacacagtcaagggccgg

SEQ ID NO: 394 - DNA, 57 bp, Artificial Sequence
  Synthetic Polynucleotide
  misc_feature (34)..(37): n is a, c, g, or t
acactctttccctacacgacgctcttccgatctnnnncccacctttgaggaggcaaa

SEQ ID NO: 395 - DNA, 51 bp, Artificial Sequence
  Synthetic Polynucleotide
tggagttcagacgtgtgctcttccgatctttccatctgagaagagagtggt

SEQ ID NO: 396 - DNA, 57 bp, Artificial Sequence
  Synthetic Polynucleotide
  misc_feature (34)..(37): n is a, c, g, or t
acactctttccctacacgacgctcttccgatctnnnngtcataccttggcccttcct

SEQ ID NO: 397 - DNA, 47 bp, Artificial Sequence
  Synthetic Polynucleotide
tggagttcagacgtgtgctcttccgatcttccctaggcccacaccag

SEQ ID NO: 398 - DNA, 57 bp, Artificial Sequence
  Synthetic Polynucleotide
  misc_feature (34)..(37): n is a, c, g, or t
acactctttccctacacgacgctcttccgatctnnnnaacccactgaagaagcaggg

SEQ ID NO: 399 - DNA, 49 bp, Artificial Sequence
  Synthetic Polynucleotide
tggagttcagacgtgtgctcttccgatctggtgcttaatccggctccat

SEQ ID NO: 400 - DNA, 57 bp, Artificial Sequence
  Synthetic Polynucleotide
  misc_feature (34)..(37): n is a, c, g, or t
acactctttccctacacgacgctcttccgatctnnnntccagtgtttccatcccgaa

SEQ ID NO: 401 - DNA, 49 bp, Artificial Sequence
  Synthetic Polynucleotide
tggagttcagacgtgtgctcttccgatctcctctgacctccacaactct

SEQ ID NO: 402 - DNA, 57 bp, Artificial Sequence
  Synthetic Polynucleotide
  misc_feature (34)..(37): n is a, c, g, or t
acactctttccctacacgacgctcttccgatctnnnnctgggtacagttctgcgtgt

SEQ ID NO: 403 - DNA, 49 bp, Artificial Sequence
  Synthetic Polynucleotide
tggagttcagacgtgtgctcttccgatcttcactctgagcatcgccaag

SEQ ID NO: 404 - DNA, 60 bp, Artificial Sequence
  Synthetic Polynucleotide
  misc_feature (34)..(37): n is a, c, g, or t
acactctttccctacacgacgctcttccgatctnnnnggtttagagccagtgaactagag

SEQ ID NO: 405 - DNA, 56 bp, Artificial Sequence
  Synthetic Polynucleotide
tggagttcagacgtgtgctcttccgatctgcaagacaaaatcctctttatactttg

SEQ ID NO: 406 - DNA, 55 bp, Artificial Sequence
  Synthetic Polynucleotide
  misc_feature (34)..(37): n is a, c, g, or t
acactctttccctacacgacgctcttccgatctnnnngggaggggacggccttac

SEQ ID NO: 407 - DNA, 47 bp, Artificial Sequence
  Synthetic Polynucleotide
tggagttcagacgtgtgctcttccgatctgcctctggcgaacatggc

SEQ ID NO: 408 - DNA, 57 bp, Artificial Sequence
  Synthetic Polynucleotide
  misc_feature (34)..(37): n is a, c, g, or t
acactctttccctacacgacgctcttccgatctnnnntcctggttaagagcatgggc

SEQ ID NO: 409 - DNA, 49 bp, Artificial Sequence
  Synthetic Polynucleotide
tggagttcagacgtgtgctcttccgatctgattgagtccccacagcaca

SEQ ID NO: 410 - DNA, 57 bp, Artificial Sequence
  Synthetic Polynucleotide
  misc_feature (34)..(37): n is a, c, g, or t
acactctttccctacacgacgctcttccgatctnnnnccagtgtttcccatccccaa

SEQ ID NO: 411 - DNA, 50 bp, Artificial Sequence
  Synthetic Polynucleotide
tggagttcagacgtgtgctcttccgatcttgacctccacaactggaaaat

SEQ ID NO: 412 - DNA, 57 bp, Artificial Sequence
  Synthetic Polynucleotide
  misc_feature (34)..(37): n is a, c, g, or t
acactctttccctacacgacgctcttccgatctnnnngcttccagacccacctgaag

SEQ ID NO: 413 - DNA, 50 bp, Artificial Sequence
  Synthetic Polynucleotide
tggagttcagacgtgtgctcttccgatctaccgaggaaaattgcttgtcg

SEQ ID NO: 414 - DNA, 58 bp, Artificial Sequence
  Synthetic Polynucleotide
  misc_feature (34)..(37): n is a, c, g, or t
acactctttccctacacgacgctcttccgatctnnnngtgtggagagtgagtaagcca

SEQ ID NO: 415 - DNA, 50 bp, Artificial Sequence
  Synthetic Polynucleotide
tggagttcagacgtgtgctcttccgatctacggtaggatgatttcaggca

SEQ ID NO: 416 - DNA, 58 bp, Artificial Sequence
  Synthetic Polynucleotide
  misc_feature (34)..(37): n is a, c, g, or t
acactctttccctacacgacgctcttccgatctnnnncacaaagcagtgtagctcagg

SEQ ID NO: 417 - DNA, 54 bp, Artificial Sequence
  Synthetic Polynucleotide
tggagttcagacgtgtgctcttccgatcttttttggtactcgagtgttattcag

SEQ ID NO: 418 - DNA, 57 bp, Artificial Sequence
  Synthetic Polynucleotide
  misc_feature (34)..(37): n is a, c, g, or t
acactctttccctacacgacgctcttccgatctnnnntcccctgttgacctggagaa

SEQ ID NO: 419 - DNA, 49 bp, Artificial Sequence
  Synthetic Polynucleotide
tggagttcagacgtgtgctcttccgatctcactgtacttgccctgacca

SEQ ID NO: 420 - DNA, 57 bp, Artificial Sequence
  Synthetic Polynucleotide
  misc_feature (34)..(37): n is a, c, g, or t
acactctttccctacacgacgctcttccgatctnnnnttggtgttgacagggagcaa

SEQ ID NO: 421 - DNA, 49 bp, Artificial Sequence
  Synthetic Polynucleotide
tggagttcagacgtgtgctcttccgatctctgagatgtgggcagaaggg

SEQ ID NO: 422 - DNA, 57 bp, Artificial Sequence
  Synthetic Polynucleotide
  misc_feature (34)..(37): n is a, c, g, or t
acactctttccctacacgacgctcttccgatctnnnntgagagggaacagaagggct

SEQ ID NO: 423 - DNA, 49 bp, Artificial Sequence
  Synthetic Polynucleotide
tggagttcagacgtgtgctcttccgatgtgtccaaaggcccaagaacct

SEQ ID NO: 424 - DNA, 58 bp, Artificial Sequence
  Synthetic Polynucleotide
  misc_feature (34)..(37): n is a, c, g, or t
acactctttccctacacgacgctcttccgatctnnnntcctagcactttggaaggtcg

SEQ ID NO: 425 - DNA, 51 bp, Artificial Sequence
  Synthetic Polynucleotide
tggagttcagacgtgtgctcttccgatctgctcatcttaatctgctcagcc

SEQ ID NO: 426 - DNA, 57 bp, Artificial Sequence
  Synthetic Polynucleotide
  misc_feature (34)..(37): n is a, c, g, or t
acactctttccctacacgacgctcttccgatctnnnnaaaggagcagctcttcctgg

SEQ ID NO: 427 - DNA, 49 bp, Artificial Sequence
  Synthetic Polynucleotide
tggagttcagacgtgtgctcttccgatctgtctgcaccatctcccacaa

SEQ ID NO: 428 - DNA, 57 bp, Artificial Sequence
  Synthetic Polynucleotide
  misc_feature (34)..(37): n is a, c, g, or t
acactctttccctacacgacgctcttccgatctnnnnggcatggcttctgagactca

SEQ ID NO: 429 - DNA, 53 bp, Artificial Sequence
  Synthetic Polynucleotide
tggagttcagacgtgtgctcttccgatctgtctcccttgcactccctgtcttt

SEQ ID NO: 430 - DNA, 57 bp, Artificial Sequence
  Synthetic Polynucleotide
  misc_feature (34)..(37): n is a, c, g, or t
acactctttccctacacgacgctcttccgatctnnnntttggcaatggaggcattgg

SEQ ID NO: 431 - DNA, 49 bp, Artificial Sequence
  Synthetic Polynucleotide
tggagttcagacgtgtgctcttccgatctgaagaggctgcccatgagag

SEQ ID NO: 432 - DNA, 57 bp, Artificial Sequence
  Synthetic Polynucleotide
  misc_feature (34)..(37): n is a, c, g, or t
acactctttccctacacgacgctcttccgatctnnnnggtctgaggctcgaatcctg

SEQ ID NO: 433 - DNA, 49 bp, Artificial Sequence
  Synthetic Polynucleotide
tggagttcagacgtgtgctcttccgatctctgtggcctccatatccctg

SEQ ID NO: 434 - DNA, 57 bp, Artificial Sequence
  Synthetic Polynucleotide
  misc_feature (34)..(37): n is a, c, g, or t
acactctttccctacacgacgctcttccgatctnnnntttccaccagaactcagccc

SEQ ID NO: 435 - DNA, 49 bp, Artificial Sequence
  Synthetic Polynucleotide
tggagttcagacgtgtgctcttccgatctcctcggttcctccacaacac

SEQ ID NO: 436 - DNA, 57 bp, Artificial Sequence
  Synthetic Polynucleotide
  misc_feature (34)..(37): n is a, c, g, or t
acactctttccctacacgacgctcttccgatctnnnncacgggaaggacaggagaag

SEQ ID NO: 437 - DNA, 49 bp, Artificial Sequence
  Synthetic Polynucleotide
tggagttcagacgtgtgctcttccgatctgcaggggagggataaagcag

SEQ ID NO: 438 - DNA, 55 bp, Artificial Sequence
  Synthetic Polynucleotide
  misc_feature (34)..(37): n is a, c, g, or t
acactctttccctacacgacgctcttccgatctnnnngtcagtctcggcccctca

SEQ ID NO: 439 - DNA, 49 bp, Artificial Sequence
  Synthetic Polynucleotide
tggagttcagacgtgtgctcttccgatctgccactgtaaagctcttggg

SEQ ID NO: 440 - DNA, 58 bp, Artificial Sequence
  Synthetic Polynucleotide
  misc_feature (35)..(38): n is a, c, g, or t
acactctttccctacacgaacgctcttccgatctnnnnagggtagagggacagagctg

SEQ ID NO: 441 - DNA, 49 bp, Artificial Sequence
  Synthetic Polynucleotide
tggagttcagacgtgtgctcttccgatctggaccccacatagtcagtgc

SEQ ID NO: 442 - DNA, 58 bp, Artificial Sequence
  Synthetic Polynucleotide
  misc_feature (34)..(37): n is a, c, g, or t
acactctttccctacacgacgctcttccgatctnnnngctgtcagccctatctccatc

SEQ ID NO: 443 - DNA, 49 bp, Artificial Sequence
  Synthetic Polynucleotide
tggagttcagacgtgtgctcttccgatcttgggcaattaggacagggac

SEQ ID NO: 444 - DNA, 57 bp, Artificial Sequence
  Synthetic Polynucleotide
  misc_feature (34)..(37): n is a, c, g, or t
acactctttccctacacgacgctcttccgatctnnnngcagcggaggaggtagattg

SEQ ID NO: 445 - DNA, 49 bp, Artificial Sequence
  Synthetic Polynucleotide
tggagttcagacgtgtgctcttccgatctctcagtacctggagtcccga

SEQ ID NO: 446 - DNA, 57 bp, Artificial Sequence
  Synthetic Polynucleotide
  misc_feature (34)..(37): n is a, c, g, or t
acactctttccctacacgacgctcttccgatctnnnngacaggctcaggaaagctgt

SEQ ID NO: 447 - DNA, 49 bp, Artificial Sequence
  Synthetic Polynucleotide
tggagttcagacgtgtgctcttccgatctacacaagcctttctccaggg

SEQ ID NO: 448 - DNA, 57 bp, Artificial Sequence
  Synthetic Polynucleotide
  misc_feature (34)..(37): n is a, c, g, or t
acactctttccctacacgacgctcttccgatctnnnnaatagggggtgagactgggg

SEQ ID NO: 449 - DNA, 49 bp, Artificial Sequence
  Synthetic Polynucleotide
tggagttcagacgtgtgctcttccgatctgcctcagacgagacttgagg

SEQ ID NO: 450 - DNA, 57 bp, Artificial Sequence
  Synthetic Polynucleotide
  misc_feature (34)..(37): n is a, c, g, or t
acactctttccctacacgacgctcttccgatctnnnnggccagcaggaaaggaatct

SEQ ID NO: 451 - DNA, 49 bp, Artificial Sequence
  Synthetic Polynucleotide
tggagttcagacgtgtgctcttccgatcttgactgcacctgtagccatg

SEQ ID NO: 452 - DNA, 57 bp, Artificial Sequence
  Synthetic Polynucleotide
  misc_feature (34)..(37): n is a, c, g, or t
acactctttccctacacgacgctcttccgatctnnnntcaaggaaatcaccctgccc

SEQ ID NO: 453 - DNA, 49 bp, Artificial Sequence
  Synthetic Polynucleotide
tggagttcagacgtgtgctcttccgatctaacttccttggtgtgcagct

SEQ ID NO: 454 - DNA, 57 bp, Artificial Sequence
  Synthetic Polynucleotide
  misc_feature (34)..(37): n is a, c, g, or t
acactctttccctacacgacgctcttccgatctnnnnatgggctcagctacgtcatg

SEQ ID NO: 455 - DNA, 49 bp, Artificial Sequence
  Synthetic Polynucleotide
tggagttcagacgtgtgctcttccgatctaatcgcagtgtggtgggcaa

SEQ ID NO: 456 - DNA, 57 bp, Artificial Sequence
  Synthetic Polynucleotide
  misc_feature (34)..(37): n is a, c, g, or t
acactctttccctacacgacgctcttccgatctnnnncgcacatcccttgtctctct

SEQ ID NO: 457 - DNA, 49 bp, Artificial Sequence
  Synthetic Polynucleotide
tggagttcagacgtgtgctcttccgatctctactggagcacaccccaag

SEQ ID NO: 458 - DNA, 57 bp, Artificial Sequence
  Synthetic Polynucleotide
  misc_feature (34)..(37): n is a, c, g, or t
acactctttccctacacgacgctcttccgatctnnnntgggtcacgtagctttggtc

SEQ ID NO: 459 - DNA, 48 bp, Artificial Sequence
  Synthetic Polynucleotide
tggagttcagacgtgtgctcttccgatcttgtggccatgtgcaactaa

SEQ ID NO: 460 - DNA, 57 bp, Artificial Sequence
  Synthetic Polynucleotide
  misc_feature (34)..(37): n is a, c, g, or t
acactctttccctacacgacgctcttccgatctnnnnctactacgtgccagctcagg

SEQ ID NO: 461 - DNA, 49 bp, Artificial Sequence
  Synthetic Polynucleotide
tggagttcagacgtgtgctcttccgatctacctcccctcctcactaacc

SEQ ID NO: 462 - DNA, 57 bp, Artificial Sequence
  Synthetic Polynucleotide
  misc_feature (34)..(37): n is a, c, g, or t
acactctttccctacacgacgctcttccgatctnnnngcctcagctccatttcctgt

SEQ ID NO: 463 - DNA, 49 bp, Artificial Sequence
  Synthetic Polynucleotide
tggagttcagacgtgtgctcttccgatctaacctttatggcaccagggg

SEQ ID NO: 464 - DNA, 57 bp, Artificial Sequence
  Synthetic Polynucleotide
  misc_feature (34)..(37): n is a, c, g, or t
acactctttccctacacgacgctcttccgatctnnnngagctcagcattagcaggct

SEQ ID NO: 465 - DNA, 49 bp, Artificial Sequence
  Synthetic Polynucleotide
tggagttcagacgtgtgctcttccgatctttcctggctttccgattccc

SEQ ID NO: 466 - DNA, 57 bp, Artificial Sequence
  Synthetic Polynucleotide
  misc_feature (34)..(37): n is a, c, g, or t
acactctttccctacacgacgctcttccgatctnnnngtgcaattggaggaggagct

SEQ ID NO: 467 - DNA, 49 bp, Artificial Sequence
  Synthetic Polynucleotide
tggagttcagacgtgtgctcttccgatctcaccagctacaggcagaaca

SEQ ID NO: 468 - DNA, 57 bp, Artificial Sequence
  Synthetic Polynucleotide
  misc_feature (34)..(37): n is a, c, g, or t
acactctttccctacacgacgctcttccgatctnnnncctacccccaacacagatgg

SEQ ID NO: 469 - DNA, 49 bp, Artificial Sequence
  Synthetic Polynucleotide
tggagttcagacgtgtgctcttccgatctccacacaactcaggtcctcc

SEQ ID NO: 470 - DNA, 200 bp, Artificial Sequence
  Synthetic Polynucleotide
tcatctgtgcccctccctccctggcccaggtgaaggtgtggttccagaaccggaggacaaagtacaaacggcagaagctggaggaggaagggcctgagtttgagcagaagaagaagggctcccatcacatcaaccggtggcgcattgccacgaagcaggccaatggggaggacatcgatgtcacctccaatgactagggt

SEQ ID NO: 471 - DNA, 200 bp, Artificial Sequence
  Synthetic Polynucleotide
accctagtcattggaggtgacatcgatctcctccccattggcctgcttcgtggcaatgcgccaccggttgatgtgatgggagcccttcttcttctgctcaaactcaggcccttcctcctccagcttctgccgtttgtactttgtcctccggttctggaaccacaccttcacctgggccagggagggaggggcacagatga

SEQ ID NO: 472 - DNA, 201 bp, Artificial Sequence
  Synthetic Polynucleotide
catgcaattagtctatttctgctgcaagtaagcatgcatttgtaggcttgatgctttttttctgcttctccagccctggcctgggtcaatccttggggcttagactgagcacgtgatggcagaggaaaggaagccctgcttcctccagagggcgtcgcaggacagcttttcctagacagggggctagtatgtgcagctcct

SEQ ID NO: 473 - DNA, 200 bp, Artificial Sequence
  Synthetic Polynucleotide
aggagctgcacatactagcccctgtctaggaaaagctgtcctgcgacgccctctggaggaagcagggcttcctttcctctgccatcacgtgctcagtctaagccccaaggattgacccaggccagggctggagaagcagaaaaaaagcatcaagcctacaaatgcatgcttacttgcagcagaaatagactaattgcatc

SEQ ID NO: 474 - DNA, 200 bp, Artificial Sequence
  Synthetic Polynucleotide
ggctgacaaaggccgggctgggtggaaggaagggaggaagggcgaggcagagggtccaaagcaggatgacaggcaggggcaccgcggcgccccggtggcattgcggctggaggtgggggttaaagcggagactctggtgctgtgtgactacagtgggggccctgccctctctgagcccccgcctccaggcctgtgtgtgt

SEQ ID NO: 475 - DNA, 200 bp, Artificial Sequence
  Synthetic Polynucleotide
acacacacaggcctggaggcgggggctcagagagggcagggcccccactgtagtcacacagcaccagagtctccgctttaacccccacctccagccgcaatgccaccggggcgccgcggtgcccctgcctgtcatcctgctttggaccctctgcctcgcccttcctcccttccttccacccagcccggcctttgtcagcc

SEQ ID NO: 476 - DNA, 200 bp, Artificial Sequence
  Synthetic Polynucleotide
agcaccgaggagctgcgggtgcgcctcgcctcccacctgcgcaagctgcgtaagcggctcctccgcgatgccgatgacctgcagaagtgcctggcagtgtaccaggccggggcccgcgagggcgccgagcgcggcctcagcgccatccgcgagcgcctggggcccctggtggaacagggccgcgtgcgggccgccactgt

SEQ ID NO: 477 - DNA, 200 bp, Artificial Sequence
  Synthetic Polynucleotide
acagtggcggcccgcacgcggccctgttccaccaggggccccaggcgctcgcggatggcgctgaggccgcgctcggcgccctcgcgggccccggcctggtacactgccaggcacttctgcaggtcatcggcatcgcggaggagccgcttacgcagcttgcgcaggtgggaggcgaggcgcacccgcagctcctcggtgct

SEQ ID NO: 478 - DNA, 200 bp, Artificial Sequence
  Synthetic Polynucleotide
actcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctg

SEQ ID NO: 479 - DNA, 200 bp, Artificial Sequence
  Synthetic Polynucleotide
cagccccagctgctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagt

SEQ ID NO: 480 - DNA, 23 bp, Artificial Sequence
  Synthetic Polynucleotide
gagtccgagcagaagaagaaggg

SEQ ID NO: 481 - DNA, 23 bp, Artificial Sequence
  Synthetic Polynucleotide
gagtctaagcagaagaagaagag

SEQ ID NO: 482 - DNA, 23 bp, Artificial Sequence
  Synthetic Polynucleotide
gaggccgagcagaagaaagacgg

SEQ ID NO: 483 - DNA, 23 bp, Artificial Sequence
  Synthetic Polynucleotide
gagtcctagcaggagaagaagag

SEQ ID NO: 484 - DNA, 23 bp, Artificial Sequence
  Synthetic Polynucleotide
ggcccagactgagcacgtgatgg

SEQ ID NO: 485 - DNA, 23 bp, Artificial Sequence
  Synthetic Polynucleotide
cacccagactgagcacgtgctgg

SEQ ID NO: 486 - DNA, 23 bp, Artificial Sequence
  Synthetic Polynucleotide
gacacagactgggcacgtgaggg

SEQ ID NO: 487 - DNA, 23 bp, Artificial Sequence
  Synthetic Polynucleotide
agctcagactgagcaagtgaggg

SEQ ID NO: 488 - DNA, 23 bp, Artificial Sequence
  Synthetic Polynucleotide
gaccccctccaccccgcctccgg

SEQ ID NO: 489 - DNA, 23 bp, Artificial Sequence
  Synthetic Polynucleotide
ctacccctccaccccgcctccgg

SEQ ID NO: 490 - DNA, 23 bp, Artificial Sequence
  Synthetic Polynucleotide
attcccccccaccccgcctcagg

SEQ ID NO: 491 - DNA, 23 bp, Artificial Sequence
  Synthetic Polynucleotide
acacccccccaccccgcctcagg

SEQ ID NO: 492 - DNA, 23 bp, Artificial Sequence
  Synthetic Polynucleotide
tgccccccccaccccacctctgg

SEQ ID NO: 493 - DNA, 23 bp, Artificial Sequence
  Synthetic Polynucleotide
ggaatcccttctgcagcacctgg

SEQ ID NO: 494 - DNA, 23 bp, Artificial Sequence
  Synthetic Polynucleotide
ggaaccccgtctgcagcaccagg

SEQ ID NO: 495 - DNA, 23 bp, Artificial Sequence
  Synthetic Polynucleotide
ggagtccctcctacagcaccagg

SEQ ID NO: 496 - DNA, 23 bp, Artificial Sequence
  Synthetic Polynucleotide
agaggcccctctgcagcaccagg

SEQ ID NO: 497 - DNA, 23 bp, Artificial Sequence
  Synthetic Polynucleotide
gaccccctccaccccgcctccgg

SEQ ID NO: 498 - DNA, 23 bp, Artificial Sequence
  Synthetic Polynucleotide
tcccccctccaccccacctccgg

SEQ ID NO: 499 - DNA, 23 bp, Artificial Sequence
  Synthetic Polynucleotide
tgcccacctcaccccgcctctgg

SEQ ID NO: 500 - DNA, 23 bp, Artificial Sequence
  Synthetic Polynucleotide
gcccctcccaaccccacctctgg

SEQ ID NO: 501 - DNA, 23 bp, Artificial Sequence
  Synthetic Polynucleotide
cacccccctcaccccgcctcagg

SEQ ID NO: 502 - DNA, 37 bp, Artificial Sequence
  Synthetic Polynucleotide
  misc_feature (34)..(37): n is a, c, g, or t
acactctttccctacacgacgctcttccgatctnnnn

SEQ ID NO: 503 - DNA, 29 bp, Artificial Sequence
  Synthetic Polynucleotide
tggagttcagacgtgtgctcttccgatct

SEQ ID NO: 504 - DNA, 57 bp, Artificial Sequence
  Synthetic Polynucleotide
  misc_feature (30)..(37): n is a, c, g, or t
aatgatacggcgaccaccgagatctacacnnnnnnnnacactctttccctacacgac

SEQ ID NO: 505 - DNA, 59 bp, Artificial Sequence
  Synthetic Polynucleotide
  misc_feature (25)..(31): n is a, c, g, or t
caagcagaagacggcatacgagatnnnnnnngtgactggagttcagacgtgtgctcttc

SEQ ID NO: 506 - DNA, 60 bp, Artificial Sequence
  Synthetic Polynucleotide
  misc_feature (34)..(37): n is a, c, g, or t
acactctttccctacacgacgctcttccgatctnnnntcctacaagtaacagtccaagaa

SEQ ID NO: 507 - DNA, 53 bp, Artificial Sequence
  Synthetic Polynucleotide
tggagttcagacgtgtgctcttccgatctttctgcaacttaacttacgtgaaa

SEQ ID NO: 508 - DNA, 57 bp, Artificial Sequence
  Synthetic Polynucleotide
  misc_feature (34)..(37): n is a, c, g, or t
acactctttccctacacgacgctcttccgatctnnnnaccaagcccatttgtccagg

SEQ ID NO: 509 - DNA, 51 bp, Artificial Sequence
  Synthetic Polynucleotide
tggagttcagacgtgtgctcttccgatcttccttctttttgagctttgggc

SEQ ID NO: 510 - DNA, 57 bp, Artificial Sequence
  Synthetic Polynucleotide
  misc_feature (34)..(37): n is a, c, g, or t
acactctttccctacacgacgctcttccgatctnnnntccataccagcagcagttcc

SEQ ID NO: 511 - DNA, 48 bp, Artificial Sequence
  Synthetic Polynucleotide
tggagttcagacgtgtgctcttccgatctctcacctcagctcctgcac

SEQ ID NO: 512 - DNA, 59 bp, Artificial Sequence
  Synthetic Polynucleotide
  misc_feature (34)..(37): n is a, c, g, or t
acactctttccctacacgacgctcttccgatctnnnncccactgattctacaccatggt

SEQ ID NO: 513 - DNA, 51 bp, Artificial Sequence
  Synthetic Polynucleotide
tggagttcagacgtgtgctcttccgatctggagttcccaacctttttgaca

SEQ ID NO: 514 - DNA, 59 bp, Artificial Sequence
  Synthetic Polynucleotide
  misc_feature (34)..(37): n is a, c, g, or t
acactctttccctacacgacgctcttccgatctnnnnctggctggagattcagagacac

SEQ ID NO: 515 - DNA, 51 bp, Artificial Sequence
  Synthetic Polynucleotide
tggagttcagacgtgtgctcttccgatctctgccccttctgacacacatac

SEQ ID NO: 516 - DNA, 59 bp, Artificial Sequence
  Synthetic Polynucleotide
  misc_feature (34)..(37): n is a, c, g, or t
acactctttccctacacgacgctcttccgatctnnnnacccctcaaggcttgacatttc

SEQ ID NO: 517 - DNA, 51 bp, Artificial Sequence
  Synthetic Polynucleotide
tggagttcagacgtgtgctcttccgatcttgaaaagttgggagaggggatg

SEQ ID NO: 518 - DNA, 59 bp, Artificial Sequence
  Synthetic Polynucleotide
  misc_feature (34)..(37): n is a, c, g, or t
acactctttccctacacgacgctcttccgatctnnnntttgtaccccagtcccctcatc

SEQ ID NO: 519 - DNA, 52 bp, Artificial Sequence
  Synthetic Polynucleotide
tggagttcagacgtgtgctcttccgatcttgaagttacggggatgtcacttg

SEQ ID NO: 520 - DNA, 61 bp, Artificial Sequence
  Synthetic Polynucleotide
  misc_feature (34)..(37): n is a, c, g, or t
acactctttccctacacgacgctcttccgatctnnnnttaacatccagtctcccaaacaca

SEQ ID NO: 521 - DNA, 51 bp, Artificial Sequence
  Synthetic Polynucleotide
tggagttcagacgtgtgctcttccgatctacacacacacactactaggaca

SEQ ID NO: 522 - DNA, 57 bp, Artificial Sequence
  Synthetic Polynucleotide
  misc_feature (34)..(37): n is a, c, g, or t
acactctttccctacacgacgctcttccgatctnnnncgctactacggagcgagaag

SEQ ID NO: 523 - DNA, 49 bp, Artificial Sequence
  Synthetic Polynucleotide
tggagttcagacgtgtgctcttccgatctacaggggcaaagtgagtgac

SEQ ID NO: 524 - DNA, 25 bp, Artificial Sequence
  Synthetic Polynucleotide
aaaaaaagcaccgactcggtgccac

SEQ ID NO: 525 - DNA, 60 bp, Artificial Sequence; identical to SEQ ID NO: 295
  Synthetic Polynucleotide

SEQ ID NO: 526 - DNA, 60 bp, Artificial Sequence; identical to SEQ ID NO: 296
  Synthetic Polynucleotide

SEQ ID NO: 527 - DNA, 60 bp, Artificial Sequence; identical to SEQ ID NO: 298
  Synthetic Polynucleotide

SEQ ID NO: 528 - DNA, 59 bp, Artificial Sequence
  Synthetic Polynucleotide
taatacgactcactataggaccccctccaccccgcctcgttttagagctagaaatagca

SEQ ID NO: 529 - DNA, 60 bp, Artificial Sequence
  Synthetic Polynucleotide
taatacgactcactataggtctctctctctctctctctcgttttagagctagaaatagca

SEQ ID NO: 530 - DNA, 22 bp, Artificial Sequence
  Synthetic Polynucleotide
ggtgtttcgtcctttccacaag

SEQ ID NO: 531 - DNA, 55 bp, Artificial Sequence
  Synthetic Polynucleotide
gaccccctccaccccgcctcgttttagagctagaaatagcaagttaaaataaggc

SEQ ID NO: 532 - DNA, 79 bp, Artificial Sequence
  Synthetic Polynucleotide
acgtaaacggccacaagttcgcggcgatcgtctctctctctctctctctctggatcgcctggcatcttcttcaaggacg

SEQ ID NO: 533 - DNA, 79 bp, Artificial Sequence
  Synthetic Polynucleotide
cgtccttgaagaagatgccaggcgatccagagagagagagagagagagacgatcgccgcgaacttgtggccgtttacgt

SEQ ID NO: 534 - DNA, 57 bp, Artificial Sequence; identical to SEQ ID NO: 362
  Synthetic Polynucleotide
  misc_feature (34)..(37): n is a, c, g, or t

SEQ ID NO: 535 - DNA, 48 bp, Artificial Sequence; identical to SEQ ID NO: 363
  Synthetic Polynucleotide

SEQ ID NO: 536 - DNA, 57 bp, Artificial Sequence; identical to SEQ ID NO: 364
  Synthetic Polynucleotide
  misc_feature (34)..(37): n is a, c, g, or t

SEQ ID NO: 537 - DNA, 47 bp, Artificial Sequence; identical to SEQ ID NO: 365
  Synthetic Polynucleotide

SEQ ID NO: 538 - DNA, 57 bp, Artificial Sequence; identical to SEQ ID NO: 368
  Synthetic Polynucleotide
  misc_feature (34)..(37): n is a, c, g, or t

SEQ ID NO: 539 - DNA, 49 bp, Artificial Sequence; identical to SEQ ID NO: 369
  Synthetic Polynucleotide

SEQ ID NO: 540 - DNA, 59 bp, Artificial Sequence; identical to SEQ ID NO: 382
  Synthetic Polynucleotide
  misc_feature (34)..(37): n is a, c, g, or t

SEQ ID NO: 541 - DNA, 50 bp, Artificial Sequence; identical to SEQ ID NO: 383
  Synthetic Polynucleotide

SEQ ID NO: 542 - DNA, 56 bp, Artificial Sequence; identical to SEQ ID NO: 384
  Synthetic Polynucleotide
  misc_feature (34)..(37): n is a, c, g, or t

SEQ ID NO: 543 - DNA, 49 bp, Artificial Sequence; identical to SEQ ID NO: 385
  Synthetic Polynucleotide

SEQ ID NO: 544 - DNA, 58 bp, Artificial Sequence; identical to SEQ ID NO: 386
  Synthetic Polynucleotide
  misc_feature (34)..(37): n is a, c, g, or t

SEQ ID NO: 545 - DNA, 49 bp, Artificial Sequence; identical to SEQ ID NO: 387
  Synthetic Polynucleotide

SEQ ID NO: 546 - DNA, 57 bp, Artificial Sequence; identical to SEQ ID NO: 398
  Synthetic Polynucleotide
  misc_feature (34)..(37): n is a, c, g, or t

SEQ ID NO: 547 - DNA, 49 bp, Artificial Sequence; identical to SEQ ID NO: 399
  Synthetic Polynucleotide

SEQ ID NO: 548 - DNA, 57 bp, Artificial Sequence; identical to SEQ ID NO: 400
  Synthetic Polynucleotide
  misc_feature (34)..(37): n is a, c, g, or t

SEQ ID NO: 549 - DNA, 49 bp, Artificial Sequence; identical to SEQ ID NO: 401
  Synthetic Polynucleotide

SEQ ID NO: 550 - DNA, 57 bp, Artificial Sequence; identical to SEQ ID NO: 402
  Synthetic Polynucleotide
  misc_feature (34)..(37): n is a, c, g, or t

SEQ ID NO: 551 - DNA, 49 bp, Artificial Sequence; identical to SEQ ID NO: 403
  Synthetic Polynucleotide

SEQ ID NO: 552 - DNA, 57 bp, Artificial Sequence; identical to SEQ ID NO: 418
  Synthetic Polynucleotide
  misc_feature (34)..(37): n is a, c, g, or t

SEQ ID NO: 553 - DNA, 49 bp, Artificial Sequence; identical to SEQ ID NO: 419
  Synthetic Polynucleotide

SEQ ID NO: 554 - DNA, 57 bp, Artificial Sequence; identical to SEQ ID NO: 420
  Synthetic Polynucleotide
  misc_feature (34)..(37): n is a, c, g, or t

SEQ ID NO: 555 - DNA, 49 bp, Artificial Sequence; identical to SEQ ID NO: 421
  Synthetic Polynucleotide

SEQ ID NO: 556 - DNA, 57 bp, Artificial Sequence; identical to SEQ ID NO: 422
  Synthetic Polynucleotide
  misc_feature (34)..(37): n is a, c, g, or t

SEQ ID NO: 557 - DNA, 49 bp, Artificial Sequence
  Synthetic Polynucleotide
tggagttcagacgtgtgctcttccgatctgtccaaaggcccaagaacct

SEQ ID NO: 558 - DNA, 57 bp, Artificial Sequence
  Synthetic Polynucleotide
  misc_feature (34)..(37): n is a, c, g, or t
acactctttccctacacgacgctcttccgatctnnnngttcccccgagtctgcacct

SEQ ID NO: 559 - DNA, 49 bp, Artificial Sequence
  Synthetic Polynucleotide
tggagttcagacgtgtgctcttccgatctcgaacttgcattcgccgcaa

SEQ ID NO: 560 - DNA, 57 bp, Artificial Sequence
  Synthetic Polynucleotide
  misc_feature (34)..(37): n is a, c, g, or t
acactctttccctacacgacgctcttccgatctnnnnttctgccttggcatcgggtg

SEQ ID NO: 561 - DNA, 57 bp, Artificial Sequence
  Synthetic Polynucleotide
tggagttcagacgtgtgctcttccgatctcaccataccgcccctagaactaacattc

SEQ ID NO: 562 - DNA, 59 bp, Artificial Sequence
  Synthetic Polynucleotide
  misc_feature (34)..(37): n is a, c, g, or t
acactctttccctacacgacgctcttccgatctnnnnacaactgctttccatggtgtgt

SEQ ID NO: 563 - DNA, 49 bp, Artificial Sequence
  Synthetic Polynucleotide
tggagttcagacgtgtgctcttccgatcttcccagggctttcgtggaga

SEQ ID NO: 564 - DNA, 23 bp, Artificial Sequence
  Synthetic Polynucleotide
gtcaggtcgagggttctgtcagg

SEQ ID NO: 565 - DNA, 23 bp, Artificial Sequence
  Synthetic Polynucleotide
cttccaggatgagaacacagagg

SEQ ID NO: 566 - DNA, 23 bp, Artificial Sequence
  Synthetic Polynucleotide
caaccactgctcaaagatgctgg

SEQ ID NO: 567 - protein, 1368 aa, Streptococcus pyogenes [sequence omitted]

SEQ ID NO: 568 - protein, 1372 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 569 - protein, 1370 aa, Streptococcus gordonii
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 570 - protein, 1056 aa, Staphylococcus aureus
GSHMKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKAYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 571 - DNA, 22 bp, Artificial Sequence
  Synthetic Polynucleotide
aatctagtaaataaattgatgt

SEQ ID NO: 572 - DNA, 20 bp, Artificial Sequence
  Synthetic Polynucleotide
gaccaacggctaagtgaaga

SEQ ID NO: 573 - DNA, 20 bp, Artificial Sequence
  Synthetic Polynucleotide
tcctttcttcacggttgcct

SEQ ID NO: 574 - DNA, 20 bp, Artificial Sequence
  Synthetic Polynucleotide
ctcctgctcagtgatttcag

SEQ ID NO: 575 - DNA, 20 bp, Artificial Sequence
  Synthetic Polynucleotide
tgtcacacatgtagttgtag

SEQ ID NO: 576 - DNA, 20 bp, Artificial Sequence
  Synthetic Polynucleotide
cctcccggccggcggtatcc

SEQ ID NO: 577 - DNA, 23 bp, Artificial Sequence
  Synthetic Polynucleotide
ggcagccgatacccggggcaggg

SEQ ID NO: 578 - DNA, 23 bp, Artificial Sequence
  Synthetic Polynucleotide
gggcagccgatacccggggcagg

SEQ ID NO: 579 - DNA, 23 bp, Artificial Sequence
  Synthetic Polynucleotide
ttattgtccgaaataaaagaaga

SEQ ID NO: 580 - DNA, 23 bp, Artificial Sequence
  Synthetic Polynucleotide
attgtccgaaataaaagaagagg

SEQ ID NO: 581 - DNA, 23 bp, Artificial Sequence
  Synthetic Polynucleotide
ttgtccgaaataaaagaagagga

SEQ ID NO: 582 - DNA, 27 bp, Artificial Sequence
  Synthetic Polynucleotide
gtccgaaataaaagaagaggaaaaaat

SEQ ID NO: 583 - DNA, 28 bp, Artificial Sequence
  Synthetic Polynucleotide
gtccgaaataaaagaagaggaaaaaatt

SEQ ID NO: 584 - DNA, 23 bp, Artificial Sequence
  Synthetic Polynucleotide
caggaagcacgaggccactgagg

SEQ ID NO: 585 - DNA, 23 bp, Artificial Sequence
  Synthetic Polynucleotide
aacaggaagcacgaggccactga

SEQ ID NO: 586 - DNA, 23 bp, Artificial Sequence
  Synthetic Polynucleotide
aggaagcacgaggccactgagga

SEQ ID NO: 587 - DNA, 23 bp, Artificial Sequence
  Synthetic Polynucleotide
ttggattctggaatccattctgg

SEQ ID NO: 588 - DNA, 23 bp, Artificial Sequence
  Synthetic Polynucleotide
tctgcatccatcttcacttcaga

SEQ ID NO: 589 - DNA, 23 bp, Artificial Sequence
  Synthetic Polynucleotide
cttacagccagtaatgtcaccga

SEQ ID NO: 590 - protein, 177 aa, Artificial Sequence
  Synthetic Polypeptide
ASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRQGGGAPAGGNIGGGQPQGGWGQPQQPQGGNQFSGGAQSRPQQSAPAAPSNEPPMDFDDDIPF

SEQ ID NO: 591 - DNA, 20 bp, Artificial Sequence
  Synthetic Polynucleotide
ttatttcgtggatttattta

SEQ ID NO: 592 - DNA, 22 bp, Artificial Sequence
  Synthetic Polynucleotide
tgcttctccagccctggcctgg

SEQ ID NO: 593 - protein, 10 aa, Artificial Sequence
  Synthetic Polypeptide
KRRTTISIAA

SEQ ID NO: 594 - protein, 19 aa, Artificial Sequence
  Synthetic Polypeptide
ALVFYREYIGRLKQIKFKF

SEQ ID NO: 595 - protein, 14 aa, Artificial Sequence
  Synthetic Polypeptide
LPIMAKSVLDLYEL

SEQ ID NO: 596 - protein, 5 aa, Artificial Sequence
  Synthetic Polypeptide
LLRLG

SEQ ID NO: 597 - protein, 15 aa, Artificial Sequence
  Synthetic Polypeptide
TDKEINPVVKENIEW

SEQ ID NO: 598 - protein, 8 aa, Artificial Sequence
  Synthetic Polypeptide
PPSIKRKF

SEQ ID NO: 599 - protein, 9 aa, Artificial Sequence
  Synthetic Polypeptide
LPTVQFDFT

SEQ ID NO: 600 - protein, 14 aa, Artificial Sequence
  Synthetic Polypeptide
LPLDIRGTAFQQQV

SEQ ID NO: 601 - protein, 8 aa, Artificial Sequence
  Synthetic Polypeptide
AYVVLGQF

SEQ ID NO: 602 - protein, 8 aa, Artificial Sequence
  Synthetic Polypeptide
INFYGELV

SEQ ID NO: 603 - protein, 7 aa, Artificial Sequence
  Synthetic Polypeptide
KKTGDQK

SEQ ID NO: 604 - protein, 16 aa, Artificial Sequence
  Synthetic Polypeptide
SGSETPGTSESATPES

SEQ ID NO: 605 - protein, 32 aa, Artificial Sequence
  Synthetic Polypeptide
SGGSSGGSSGSETPGTSESATPESSGGSSGGS

SEQ ID NO: 606 - protein, 120 aa, Artificial Sequence
  Synthetic polypeptide
  MISC_FEATURE (5)..(120): May be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 607 - protein, 150 aa, Artificial Sequence
  Synthetic polypeptide
  MISC_FEATURE (6)..(150): May be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 608 - protein, 30 aa, Artificial Sequence
  Synthetic polypeptide
  MISC_FEATURE (2)..(30): May be absent
GGGGGGGGGGGGGGGGGGGGGGGGGGGGGG

SEQ ID NO: 609 - protein, 150 aa, Artificial Sequence
  Synthetic polypeptide
  MISC_FEATURE (6)..(150): May be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 610 - protein, 90 aa, Artificial Sequence
  Synthetic polypeptide
  MISC_FEATURE (4)..(90): May be absent
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 611 - protein, 60 aa, Artificial Sequence
  Synthetic polypeptide
  misc_feature (1)..(1): Xaa can be any naturally occurring amino acid
  MISC_FEATURE (3)..(60): May be absent
XPXPXPXPXPXPXPXPXPXPXPXPXPXPXPXPXPXPXPXPXPXPXPXPXPXPXPXPXPXP

SEQ ID NO: 612 - protein, 94 aa, Artificial Sequence
  Synthetic polypeptide
  MISC_FEATURE (8)..(94): May be absent
SGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 613 - protein, 120 aa, Artificial Sequence
  Synthetic polypeptide
  MISC_FEATURE (5)..(120): May be absent
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 614 - protein, 7 aa, Artificial Sequence
  Synthetic Polypeptide
PKKKRKV

SEQ ID NO: 615 - protein, 30 aa, Artificial Sequence
  Synthetic Polypeptide
MDSLLMNRRKFLYQFKNVRWAKGRRETYLC

SEQ ID NO: 616 - protein, 36 aa, Artificial Sequence
  Synthetic Polypeptide
  misc_feature (2)..(2): Xaa can be any naturally occurring amino acid
  misc_feature (4)..(29): Xaa can be any naturally occurring amino acid
  MISC_FEATURE (27)..(29): May be absent
  misc_feature (32)..(35): Xaa can be any naturally occurring amino acid
  MISC_FEATURE (34)..(35): May be absent
HXEXXXXXXXXXXXXXXXXXXXXXXXXXXPCXXXXC

SEQ ID NO: 617 - protein, 11 aa, Artificial Sequence
  Synthetic Polypeptide
SPKKKRKVEAS

SEQ ID NO: 618 - RNA, 81 nt, Artificial Sequence
  Synthetic Polynucleotide
guuuuagagcuagaaauagcaaguuaaaauaaggcuaguccguuaucaacuugaaaaaguggcaccgagucggugcuuuuu

SEQ ID NO: 619 - DNA, 24 bp, Artificial Sequence
  Synthetic Polynucleotide
tcgcacccgtggatttatttatgg

SEQ ID NO: 620 - DNA, 24 bp, Artificial Sequence
  Synthetic Polynucleotide
ttcgcacccgtggatttattatgg

SEQ ID NO: 621 - DNA, 24 bp, Artificial Sequence
  Synthetic Polynucleotide
cctcgcacgtggatttatttatgg

SEQ ID NO: 622 - DNA, 24 bp, Artificial Sequence
  Synthetic Polynucleotide
tcctcgcacgtggatttattatgg

SEQ ID NO: 623 - DNA, 24 bp, Artificial Sequence
  Synthetic Polynucleotide
accctcgcgtggatttatttatgg

SEQ ID NO: 624 - DNA, 24 bp, Artificial Sequence
  Synthetic Polynucleotide
taccctcgcgtggatttattatgg

SEQ ID NO: 625 - DNA, 24 bp, Artificial Sequence
  Synthetic Polynucleotide
gcaccctcgtggatttatttatgg

SEQ ID NO: 626 - DNA, 24 bp, Artificial Sequence
  Synthetic Polynucleotide
tgcaccctcgtggatttattatgg

SEQ ID NO: 627 - DNA, 23 bp, Artificial Sequence
  Synthetic Polynucleotide
gaagcgcctggcagtgtaccagg

SEQ ID NO: 628 - DNA, 23 bp, Artificial Sequence
  Synthetic Polynucleotide
ccactacaactacatgtgtgaca

SEQ ID NO: 629 - DNA, 23 bp, Artificial Sequence
  Synthetic Polynucleotide
ccgcgccatggccatctgcaagc

SEQ ID NO: 630 - DNA, 23 bp, Artificial Sequence
  Synthetic Polynucleotide
ggaggacgtgcgcggccgcctgg

SEQ ID NO: 631 - DNA, 23 bp, Artificial Sequence
  Synthetic Polynucleotide
gaagcgcctggcagtgtaccagg

SEQ ID NO: 632 - DNA, 23 bp, Artificial Sequence
  Synthetic Polynucleotide
ctgtggcagtggcaccagaatgg

SEQ ID NO: 633 - DNA, 23 bp, Artificial Sequence
  Synthetic Polynucleotide
cctcccggccggcggtatccagg

SEQ ID NO: 634 - DNA, 23 bp, Artificial Sequence
  Synthetic Polynucleotide
gcttgcagatggccatggcgcgg

SEQ ID NO: 635 - DNA, 23 bp, Artificial Sequence
  Synthetic Polynucleotide
acacatgcagttgtagtggatgg

SEQ ID NO: 636 - DNA, 23 bp, Artificial Sequence
  Synthetic Polynucleotide
tgtcacacatgtagttgtagtgg

SEQ ID NO: 637 - DNA, 23 bp, Artificial Sequence
  Synthetic Polynucleotide
gagttagagcagaagaagaaagg

SEQ ID NO: 638 - DNA, 23 bp, Artificial Sequence
  Synthetic Polynucleotide
gagtctaagcagaagaagaagag

SEQ ID NO: 639 - DNA, 23 bp, Artificial Sequence
  Synthetic Polynucleotide
gaggccgagcagaagaaagacgg

SEQ ID NO: 640 - DNA, 23 bp, Artificial Sequence
  Synthetic Polynucleotide
gagtcctagcaggagaagaagag

SEQ ID NO: 641 - DNA, 23 bp, Artificial Sequence
  Synthetic Polynucleotide
gagtccgggaaggagaagaaagg

SEQ ID NO: 642 - DNA, 23 bp, Artificial Sequence
  Synthetic Polynucleotide
gagccggagcagaagaaggaggg

SEQ ID NO: 643 - DNA, 23 bp, Artificial Sequence
  Synthetic Polynucleotide
aagtccgaggagaggaagaaagg

SEQ ID NO: 644 - DNA, 23 bp, Artificial Sequence
  Synthetic Polynucleotide
gaatccaagcaggagaagaagga

SEQ ID NO: 645 - DNA, 23 bp, Artificial Sequence
  Synthetic Polynucleotide
acgtctgagcagaagaagaatgg

SEQ ID NO: 646 - DNA, 23 bp, Artificial Sequence
  Synthetic Polynucleotide
ggaaccccgtctgcagcaccagg

SEQ ID NO: 647 - DNA, 23 bp, Artificial Sequence
  Synthetic Polynucleotide
ggagtccctcctacagcaccagg

SEQ ID NO: 648 - DNA, 23 bp, Artificial Sequence
  Synthetic Polynucleotide
agaggcccctctgcagcaccagg

SEQ ID NO: 649 - DNA, 23 bp, Artificial Sequence
  Synthetic Polynucleotide
accatccctcctgcagcaccagg

SEQ ID NO: 650 - DNA, 23 bp, Artificial Sequence
  Synthetic Polynucleotide
ggattgccatccgcagcacctgg

SEQ ID NO: 651 - DNA, 23 bp, Artificial Sequence
  Synthetic Polynucleotide
tgaatcccatctccagcaccagg

SEQ ID NO: 652 - DNA, 23 bp, Artificial Sequence
  Synthetic Polynucleotide
ggagtccctcctacagcaccagg

SEQ ID NO: 653 - DNA, 23 bp, Artificial Sequence
  Synthetic Polynucleotide
ggagtccctcctgcagcacctga

SEQ ID NO: 654 - DNA, 23 bp, Artificial Sequence
  Synthetic Polynucleotide
gaacacaatgcatagattgccgg

SEQ ID NO: 655 - DNA, 23 bp, Artificial Sequence
  Synthetic Polynucleotide
aaacataaagcatagactgcaaa

SEQ ID NO: 656 - DNA, 23 bp, Artificial Sequence
  Synthetic Polynucleotide
cacccagactgagcacgtgctgg

SEQ ID NO: 657 - DNA, 23 bp, Artificial Sequence
  Synthetic Polynucleotide
gacacagactgggcacgtgaggg

SEQ ID NO: 658 - DNA, 23 bp, Artificial Sequence
  Synthetic Polynucleotide
agctcagactgagcaagtgaggg

SEQ ID NO: 659 - DNA, 23 bp, Artificial Sequence
  Synthetic Polynucleotide
agaccagactgagcaagagaggg

SEQ ID NO: 660 - DNA, 23 bp, Artificial Sequence
  Synthetic Polynucleotide
gagccagaatgagcacgtgaggg

SEQ ID NO: 661 - DNA, 23 bp, Artificial Sequence
  Synthetic Polynucleotide
tgcactgcggccggaggaggtgg

SEQ ID NO: 662 - DNA, 23 bp, Artificial Sequence
  Synthetic Polynucleotide
ggctctgcggctggagggggtgg

SEQ ID NO: 663 - DNA, 23 bp, Artificial Sequence
  Synthetic Polynucleotide
ggcacgacggctggaggtggggg

SEQ ID NO: 664 - DNA, 23 bp, Artificial Sequence
  Synthetic Polynucleotide
ggcatcacggctggaggtggagg

SEQ ID NO: 665 - DNA, 23 bp, Artificial Sequence
  Synthetic Polynucleotide
ggcgctgcggcgggaggtggagg

SEQ ID NO: 666 - DNA, 23 bp, Artificial Sequence
  Synthetic Polynucleotide
ggcactgagactgggggtggggg

SEQ ID NO: 667 - DNA, 23 bp, Artificial Sequence
  Synthetic Polynucleotide
agcagtgcggctagaggtggtgg

SEQ ID NO: 668 - DNA, 23 bp, Artificial Sequence
  Synthetic Polynucleotide
ggcactgctactgggggtggtgg

SEQ ID NO: 669 - DNA, 23 bp, Artificial Sequence
  Synthetic Polynucleotide
ggcactggggctgggggaggggg

SEQ ID NO: 670 - DNA, 23 bp, Artificial Sequence
  Synthetic Polypeptide
ggcactggggttggaggtggggg

SEQ ID NO: 671 - protein, 7 aa, Artificial Sequence
  Synthetic Polypeptide
KRLAVYQ

SEQ ID NO: 672 - protein, 7 aa, Artificial Sequence
  Synthetic Polypeptide
RAMAICK

SEQ ID NO: 673 - DNA, 23 bp, Artificial Sequence
  Synthetic Polynucleotide
tcagggtgagcatagactgccgg

SEQ ID NO: 674 - DNA, 23 bp, Artificial Sequence
  Synthetic Polynucleotide
gaatcgggaggggagactgcggg

SEQ ID NO: 675 - DNA, 23 bp, Artificial Sequence
  Synthetic Polynucleotide
tgaagtgttgcatagactgcagg

SEQ ID NO: 676 - DNA, 23 bp, Artificial Sequence
  Synthetic Polynucleotide
ggagagagagcatagactgctgg

SEQ ID NO: 677 - DNA, 23 bp, Artificial Sequence
  Synthetic Polynucleotide
ccaaacaaaacatagactgctgg

SEQ ID NO: 678 - DNA, 23 bp, Artificial Sequence
  Synthetic Polynucleotide
caggaagctggagcacgtgaggg

SEQ ID NO: 679 - DNA, 23 bp, Artificial Sequence
  Synthetic Polynucleotide
aaggctgagggagcacgtgaagg

SEQ ID NO: 680 - DNA, 23 bp, Artificial Sequence
  Synthetic Polynucleotide
gtcaggggaagagcacgtgacgg

SEQ ID NO: 681 - DNA, 23 bp, Artificial Sequence
  Synthetic Polynucleotide
gttgtgaactgagcacgtgaggg

SEQ ID NO: 682 - DNA, 23 bp, Artificial Sequence
  Synthetic Polynucleotide
atatttgctggagcacgtgaagg

SEQ ID NO: 683 - DNA, 23 bp, Artificial Sequence
  Synthetic Polynucleotide
gtggctggaggtggaggtggggg

SEQ ID NO: 684 - DNA, 23 bp, Artificial Sequence
  Synthetic Polynucleotide
gagggaagggctggaggtggagg

SEQ ID NO: 685 - DNA, 25 bp, Artificial Sequence
  Synthetic Polynucleotide
cacctgcgcaagctgcgtaagcggc

SEQ ID NO: 686 - DNA, 25 bp, Artificial Sequence
  Synthetic Polynucleotide
tcctccgcgatgccgatgacctgca

SEQ ID NO: 687 - DNA, 25 bp, Artificial Sequence
  Synthetic Polynucleotide
aggccggggcccgcgagggcgccga

SEQ ID NO: 688 - DNA, 25 bp, Artificial Sequence
  Synthetic Polynucleotide
gcgcggcctcagcgccatccgcgag

SEQ ID NO: 689 - DNA, 25 bp, Artificial Sequence
  Synthetic Polynucleotide
cctgtgcagctgtgggttgattcca

SEQ ID NO: 690 - DNA, 25 bp, Artificial Sequence
  Synthetic Polynucleotide
cacccccgcccggcacccgcgtccg

SEQ ID NO: 691 - DNA, 25 bp, Artificial Sequence
  Synthetic Polynucleotide
agtcacagcacatgacggaggttgt

SEQ ID NO: 692 - DNA, 25 bp, Artificial Sequence
  Synthetic Polynucleotide
gaggcgctgcccccaccatgagcgc

SEQ ID NO: 693 - DNA, 28 bp, Artificial Sequence
  Synthetic Polynucleotide
tgccatcacgtgctcaatcggggcccca

SEQ ID NO: 694 - DNA, 29 bp, Artificial Sequence
  Synthetic Polynucleotide
cgccccgcagtctatgctttgtgttccag

SEQ ID NO: 695 - DNA, 23 bp, Artificial Sequence
  Synthetic Polynucleotide
cccgcagtctatgctttgtgttc

SEQ ID NO: 696 - DNA, 20 bp, Artificial Sequence
  Synthetic Polynucleotide
ctcccatcacatcaaccggt

SEQ ID NO: 697 - DNA, 26 bp, Artificial Sequence
  Synthetic Polynucleotide
tttcctcccccccacaggtagaacat

SEQ ID NO: 698 - DNA, 27 bp, Artificial Sequence
  Synthetic Polynucleotide
tttccctctgtccacaccctcatcctg

SEQ ID NO: 699 - DNA, 27 bp, Artificial Sequence
  Synthetic Polynucleotide
tttccccagtcctccacaccctgaaac

SEQ ID NO: 700 - DNA, 20 bp, Artificial Sequence
  Synthetic Polynucleotide
tgcccctccctccctggccc

SEQ ID NO: 701 - DNA, 20 bp, Artificial Sequence
  Synthetic Polynucleotide
agagccccccctcaaagaga

SEQ ID NO: 702 - DNA, 23 bp, Artificial Sequence
  Synthetic Polynucleotide
ggcccagactgagcacgtgatgg

SEQ ID NO: 703 - DNA, 23 bp, Artificial Sequence
  Synthetic Polynucleotide
gagtccgagcagaagaagaaggg

SEQ ID NO: 704 - DNA, 23 bp, Artificial Sequence
  Synthetic Polynucleotide
gaacacaaagcatagactgcggg

SEQ ID NO: 705 - DNA, 21 bp, Artificial Sequence
  Synthetic Polynucleotide
gagtccgagcagaagaagaag

SEQ ID NO: 706 - DNA, 23 bp, Artificial Sequence
  Synthetic Polynucleotide
ggaatcccttctgcagcacctgg

SEQ ID NO: 707 - DNA, 20 bp, Artificial Sequence
  Synthetic Polynucleotide
ggcccagactgagcacgtga

SEQ ID NO: 708 - DNA, 23 bp, Artificial Sequence
  Synthetic Polynucleotide
ggcactgcggctggaggtggggg

SEQ ID NO: 709 - DNA, 20 bp, Artificial Sequence
  Synthetic Polynucleotide
gtcaggtcgagggttctgtc

SEQ ID NO: 710 - DNA, 20 bp, Artificial Sequence
  Synthetic Polynucleotide
gggccgcagtatcctcactc

SEQ ID NO: 711 - DNA, 20 bp, Artificial Sequence
  Synthetic Polynucleotide
ccgccagtcccagtacggga

SEQ ID NO: 712 - DNA, 20 bp, Artificial Sequence
  Synthetic Polynucleotide
caaccactgctcaaagatgc

SEQ ID NO: 713 - DNA, 20 bp, Artificial Sequence
  Synthetic Polynucleotide
cttccaggatgagaacacag

SEQ ID NO: 714 - protein, 7 aa, Artificial Sequence
  Synthetic Polypeptide
GSRYPGE

SEQ ID NO: 715 - DNA, 23 bp, Artificial Sequence
  Synthetic Polynucleotide
tgcccctccctccctggcccagg

SEQ ID NO: 716 - DNA, 23 bp, Artificial Sequence
  Synthetic Polynucleotide
ttttcctcccccccacaggtaga

SEQ ID NO: 717 - DNA, 23 bp, Artificial Sequence
  Synthetic Polynucleotide
gccccccctcaaagagagggtgg

SEQ ID NO: 718 - DNA, 23 bp, Artificial Sequence
  Synthetic Polynucleotide
agagccccccctcaaagagaggg

SEQ ID NO: 719 - DNA, 23 bp, Artificial Sequence
  Synthetic Polynucleotide
ggcccagactgagcacgtgatgg

SEQ ID NO: 720 - DNA, 23 bp, Artificial Sequence
  Synthetic Polynucleotide
gaacacaaagcatagactgcggg

SEQ ID NO: 721 - DNA, 23 bp, Artificial Sequence
  Synthetic Polynucleotide
gagtccgagcagaagaagaaggg

SEQ ID NO: 722 - DNA, 23 bp, Artificial Sequence
  Synthetic Polynucleotide
ggaatcccttctgcagcacctgg

SEQ ID NO: 723 - DNA, 27 bp, Artificial Sequence
  Synthetic Polynucleotide
  misc_feature (1)..(4): n is a, c, g, or t
  misc_feature (25)..(25): n is a, c, g, or t
nnnntctctctctctctctctctcngg

SEQ ID NO: 724 - DNA, 23 bp, Artificial Sequence
  Synthetic Polynucleotide
gcggatgttccaatcagtacgca

SEQ ID NO: 725 - DNA, 23 bp, Artificial Sequence
  Synthetic Polynucleotide
cgagcttctggcggtctcaagca

SEQ ID NO: 726 - DNA, 22 bp, Artificial Sequence
  Synthetic Polynucleotide
tgcttctccagccctggcctgg

SEQ ID NO: 727 - DNA, 23 bp, Artificial Sequence
  Synthetic Polynucleotide
agactgagcacgtgatggcagag

SEQ ID NO: 728 - DNA, 26 bp, Artificial Sequence
  Synthetic Polynucleotide
gatgttccaatcagtacgcagagagt

SEQ ID NO: 729 - DNA, 26 bp, Artificial Sequence
  Synthetic Polynucleotide
cttctccagccctggcctgggtcaat

SEQ ID NO: 730 - DNA, 24 bp, Artificial Sequence
  Synthetic Polynucleotide
gccgtctccaaggtgaaagcggaa

SEQ ID NO: 731 - DNA, 24 bp, Artificial Sequence
  Synthetic Polynucleotide
gtcgccgtctccaaggtgaaagcg

SEQ ID NO: 732 - DNA, 24 bp, Artificial Sequence
  Synthetic Polynucleotide
ggtgcattttcaggaggaagcgat

SEQ ID NO: 733 - DNA, 24 bp, Artificial Sequence
  Synthetic Polynucleotide
gccgtctccaaggtgaaagcggaa

SEQ ID NO: 734 - DNA, 26 bp, Artificial Sequence
  Synthetic Polynucleotide
gccgtctccaaggtgaaagcggaagt

SEQ ID NO: 735 - DNA, 23 bp, Artificial Sequence
  Synthetic Polynucleotide
ggcactgcggctggaggtggggg

SEQ ID NO: 736 - protein, 83 aa, Bacillus phage PBS2
TNLSDIIEKETGKQLVIQESILMLPEEVEEVIGNKPESDILVHTAYDESTDENVMLLTSDAPEYKPWALVIQDSNGENKIKML

SEQ ID NO: 737 - protein, 228 aa, Rattus norvegicus
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 738 - DNA, 24 bp, Artificial Sequence
  Synthetic Polynucleotide
tttgtactttgtcctccggttctg

SEQ ID NO: 739 - DNA, 24 bp, Artificial Sequence
  Synthetic Polynucleotide
tttccagcccgctggccctgtaaa

SEQ ID NO: 740 - protein, 17 aa, Artificial Sequence
  Synthetic Polypeptide
KRTADGSEFEPKKKRKV

SEQ ID NO: 741 - DNA, 22 bp, Artificial Sequence
  Synthetic Polynucleotide
gtaatttctactaagtgtagat

SEQ ID NO: 742 - DNA, 23 bp, Artificial Sequence
  Synthetic Polynucleotide
tactttgtcctccggttctggaa

SEQ ID NO: 743 - DNA, 20 bp, Artificial Sequence
  Synthetic Polynucleotide
tactttgtcctccggttctg

SEQ ID NO: 744 - DNA, 19 bp, Artificial Sequence
  Synthetic Polynucleotide
tactttgtcctccggttct

SEQ ID NO: 745 - DNA, 18 bp, Artificial Sequence
  Synthetic Polynucleotide
tactttgtcctccggttc

SEQ ID NO: 746 - DNA, 17 bp, Artificial Sequence
  Synthetic Polynucleotide
tactttgtcctccggtt

SEQ ID NO: 747 - DNA, 23 bp, Artificial Sequence
  Synthetic Polynucleotide
cagcccgctggccctgtaaagga

SEQ ID NO: 748 - DNA, 20 bp, Artificial Sequence
  Synthetic Polynucleotide
cagcccgctggccctgtaaa

SEQ ID NO: 749 - DNA, 19 bp, Artificial Sequence
  Synthetic Polynucleotide
cagcccgctggccctgtaa

SEQ ID NO: 750 - DNA, 18 bp, Artificial Sequence
  Synthetic Polynucleotide
cagcccgctggccctgta

SEQ ID NO: 751 - DNA, 17 bp, Artificial Sequence
  Synthetic Polynucleotide
cagcccgctggccctgt

SEQ ID NO: 752 - DNA, 15 bp, Artificial Sequence
  Synthetic
gggaatgagtcaggc

SEQ ID NO: 753 - DNA, 13 bp, Artificial Sequence
  Synthetic
  misc_feature (13)..(13): n is a or g
atcgkagtaggan

SEQ ID NO: 754 - DNA, 13 bp, Artificial Sequence
  Synthetic
  misc_feature (6)..(6): n is a or g
  misc_feature (10)..(10): n is a, c, g, or t
  misc_feature (13)..(13): n is a or g
gcatgngggngan

SEQ ID NO: 755 - DNA, 32 bp, Artificial Sequence
  Synthetic
atctggtcgctggggaatgagagtggccacgg

SEQ ID NO: 756 - protein, 11 aa, Artificial Sequence
  Synthetic
IWSLGNESGHG

SEQ ID NO: 757 - DNA, 46 bp, Artificial Sequence
  Synthetic
atcatctggtcgctggggaatgggagtggccagggcgctaatcacg

SEQ ID NO: 758 - protein, 15 aa, Artificial Sequence
  Synthetic
IIWSLGNGSGHGANH

SEQ ID NO: 759 - DNA, 46 bp, Artificial Sequence
  Synthetic
atcatctggtcgctggggaatgagagtggccacggcgctaatcacg

SEQ ID NO: 760 - protein, 15 aa, Artificial Sequence
  Synthetic
IIWSLGNESGHGANH

SEQ ID NO: 761 - DNA, 85 bp, Artificial Sequence
  Synthetic
tcattaagcattctgccgacatggaagcgtcgcatacggtgtggtgcacctggatggccagcggcatcagcaccttgtcgccttg

SEQ ID NO: 762 - protein, 29 aa, Artificial Sequence
  Synthetic
ENLMRGVHFGDCVTHHVQIALPMLVKDGQ

SEQ ID NO: 763 - DNA, 89 bp, Artificial Sequence
  Synthetic
tcattaagcattctgccgacatggaagccgtcgcatacggcgcggtgcacctggatggatggccagcggcatcagcaccttgtcgcctg

SEQ ID NO: 764 - protein, 29 aa, Artificial Sequence
  Synthetic
ENLMRGVHFGDCVARHVQIALPMLVKDQQ

SEQ ID NO: 765 - DNA, 52 bp, Artificial Sequence
  Synthetic
cggcgcggtgcacctggatggatggccagcggcatcagcaccttgtcgcctg

SEQ ID NO: 766 - DNA, 60 bp, Artificial Sequence
  Synthetic
agcattctgccgacatggaagccgtcgcatatggtgtggtgcacctggatggccagcggc

SEQ ID NO: 767 - protein, 20 aa, Artificial Sequence
  Synthetic
LMRGVHFGDCITHHVQIALP

SEQ ID NO: 768 - DNA, 60 bp, Artificial Sequence
  Synthetic
agcattctgccgacatggaagccgtcgcatacggcgcggtgcacctggatggccagcggc

SEQ ID NO: 769 - protein, 20 aa, Artificial Sequence
  Synthetic
LMRGVHFGDCVARHVQIALP

SEQ ID NO: 770 - DNA, 60 bp, Artificial Sequence; identical to SEQ ID NO: 766
  Synthetic

SEQ ID NO: 771 - DNA, 143 bp, Artificial Sequence
  Synthetic
cttcactatgggcaaatattatacgcaaggcgacaaggtgctgatgccgctggccatccaggtgcaccacgccgtatgcgacggcttccatgtcggcagaatgcttaatgaattacaacagtactgcgatgagtggcagggcc

SEQ ID NO: 772 - protein, 47 aa, Artificial Sequence
  Synthetic
FTMGKYYTQGDKVLMPLAIQVHHAVCDGFHVGRMLNELQQYCDEWQG

SEQ ID NO: 773 - DNA, 143 bp, Artificial Sequence
  Synthetic
cttcactatgggcaaatattatacgcaaggcgacaaggtgctgatgccgctggccatccaggtgcaccgcgccgtatgcgacggcttccatgtcggcagaatgcttaatgaattacaacagtactgcgatgagtggcagggcc

SEQ ID NO: 774 - protein, 47 aa, Artificial Sequence
  Synthetic
FTMGKYYTQGDKVLMPLAIQVHRAVCDGFHVGRMLNELQQYCDEWQG

SEQ ID NO: 775 - protein, 6 aa, Artificial Sequence
  Synthetic
  misc_feature (2)..(2): Xaa can be Arg or Cys
KXLAYQ

SEQ ID NO: 776 - DNA, 20 bp, Artificial Sequence
  Synthetic
gaagcgcctggcagtgtacc

SEQ ID NO: 777 - DNA, 23 bp, Artificial Sequence
  Synthetic
tgcccctccctccctggcccagg

SEQ ID NO: 778 - DNA, 23 bp, Artificial Sequence
  Synthetic
agagccccccctcaaagagaggg

SEQ ID NO: 779 - DNA, 23 bp, Artificial Sequence
  Synthetic
gccccagactgagcacgtgatgg

SEQ ID NO: 780 - DNA, 23 bp, Artificial Sequence
  Synthetic
gaacacaaagcatagactgcggg

SEQ ID NO: 781 - DNA, 23 bp, Artificial Sequence
  Synthetic
ggcccagactgagcacgtgatgg

SEQ ID NO: 782 - DNA, 23 bp, Artificial Sequence
  Synthetic
ggcactgcggctggaggtccggg

SEQ ID NO: 783 - DNA, 23 bp, Artificial Sequence
  Synthetic
gtcatcttagtcattacctgagg

SEQ ID NO: 784 - DNA, 23 bp, Artificial Sequence
  Synthetic
gaatataaagcatagactgcggg

SEQ ID NO: 785 - DNA, 23 bp, Artificial Sequence
  Synthetic
gaacataaagcatagactgcggg

SEQ ID NO: 786 - DNA, 23 bp, Artificial Sequence
  Synthetic
gaatacaaagcatagactgcggg

SEQ ID NO: 787 - DNA, 26 bp, Artificial Sequence
  Synthetic
gatgttccaatcagtacgcagagagt

SEQ ID NO: 788 - DNA, 26 bp, Artificial Sequence
  Synthetic
tctgcttctccagccctggcctgggt

SEQ ID NO: 789 - DNA, 26 bp, Artificial Sequence
  Synthetic
acgtgctcagtctgggccccaaggat

SEQ ID NO: 790 - DNA, 26 bp, Artificial Sequence
  Synthetic
gtggcactgcggctggaggtgggggt

What is claimed is:

1. A fusion protein comprising: (i) a nucleic acid programmable DNA binding protein (napDNAbp); (ii) a cytidine deaminase domain; and (iii) two uracil glycosylase inhibitor (UGI) domains, wherein the napDNAbp is a CasX, CasY, Cpf1, C2c1, C2c2, C2c3, or Argonaute protein.

2. A complex comprising the fusion protein of claim 1, and a guide RNA bound to the napDNAbp of the fusion protein.

3. A method for editing a target nucleic acid molecule, the method comprising contacting the target nucleic acid molecule with the complex of claim 2, wherein the guide RNA comprises at least 10 contiguous nucleotides complementary to the target nucleic acid molecule, thereby editing the target nucleic acid molecule.

4. A method comprising contacting a nucleic acid molecule with the complex of claim 2.

5. An isolated cell comprising the complex of claim 2.

6. A pharmaceutical composition comprising the complex of claim 2.

7. An isolated cell comprising the fusion protein of claim 1.

8. A pharmaceutical composition comprising the fusion protein of claim 1.

9. A method comprising delivering the fusion protein of claim 1 to the inner ear of a subject.

10. A method comprising delivering the fusion protein of claim 1 to a zebrafish embryo.

11. The fusion protein of claim 1, wherein the cytidine deaminase domain is a deaminase from the apolipoprotein B mRNA-editing complex (APOBEC) family.

12. The fusion protein of claim 1, wherein the cytidine deaminase domain comprises an amino acid sequence that is at least 85% identical to an amino acid sequence of SEQ ID NO: 49-84, wherein said at least 85% amino acid sequence identity is based on an alignment against any one of SEQ ID NOs: 49-84 by NCBI Constraint-based Multiple Alignment Tool (COBALT).

13. A kit comprising a nucleic acid construct comprising:
    (a) a nucleic acid sequence encoding a fusion protein, wherein the fusion protein comprises (i) a nucleic acid programmable DNA binding protein (napDNAbp), wherein the napDNAbp is a CasX, CasY, Cpf1, C2c1, C2c2, C2c3, or Argonaute protein, (ii) a cytidine deaminase domain, and (iii) two uracil glycosylase inhibitor (UGI) domains; and
    (b) a heterologous promoter that drives expression of the sequence of (a).

14. A polynucleotide encoding a fusion protein, wherein the fusion protein comprises (i) a nucleic acid programmable DNA binding protein (napDNAbp), wherein the napDNAbp is a CasX, CasY, Cpf1, C2c1, C2c2, C2c3, or Argonaute protein: (ii) a cytidine deaminase domain; and (iii) two uracil glycosylase inhibitor (UGI) domains.

15. A vector comprising the polynucleotide of claim 14.

16. The vector of claim 15, wherein the vector comprises a heterologous promoter driving expression of the polynucleotide.

17. An isolated cell comprising a nucleic acid molecule encoding a fusion protein, wherein the fusion protein comprises (i) a nucleic acid programmable DNA binding protein (napDNAbp), wherein the napDNAbp is a CasX, CasY, Cpf1, C2c1, C2c2, C2c3, or Argonaute protein: (ii) a cytidine deaminase domain; and (iii) two uracil glycosylase inhibitor (UGI) domains.

18. A fusion protein comprising: (i) a nucleic acid programmable DNA binding protein (napDNAbp); (ii) a cytidine deaminase domain; (iii) a first uracil glycosylase inhibitor (UGI) domain; and (iv) a second uracil glycosylase inhibitor (UGI) domain.

19. The fusion protein of claim 18, wherein the nucleic acid programmable DNA binding protein (napDNAbp) is a CasX, CasY, Cpf1, Cpf1 nickase, dCpf1, C2c1, C2c2, C2c3, Cas9, dCas9, Cas9 nickase or Argonaute protein.

20. The fusion protein of claim 19, wherein the napDNAbp is a dCas9 or Cas9 nickase.

21. The fusion protein of claim 19, wherein the napDNAbp comprises an amino acid sequence that is at least 85% identical to SEQ ID NO: 34 or 38.

22. The fusion protein of claim 18, wherein the cytidine deaminase domain comprises an amino acid sequence that is at least 85% identical to an amino acid sequence of SEQ ID NO: 49-84, wherein said at least 85% amino acid sequence identity is based on an alignment against any one of SEQ ID NOs: 49-84 by NCBI Constraint-based Multiple Alignment Tool (COBALT).

23. The fusion protein of claim 18, wherein the fusion protein comprises the structure:

$NH_2$-[cytidine deaminase domain]-[napDNAbp]-[first UGI domain]-[second UGI domain]-COOH;

$NH_2$-[first UGI domain]-[second UGI domain]-[cytidine deaminase domain]-[napDNAbp]-COOH;

$NH_2$-[napDNAbp]-[cytidine deaminase domain]-[first UGI domain]-[second UGI domain]-COOH; or $NH_2$-[first UGI domain]-[second UGI domain]-[napDNAbp]-[cytidine deaminase domain]-COOH;

wherein each instance of "]-[" comprises an optional linker.

24. The fusion protein of claim 18, wherein the cytidine deaminase domain and the napDNAbp are linked via a linker comprising the amino acid sequence: SGGSSG-GSSGSETPGTSESATPESSGGSSGGS (SEQ ID NO: 605).

25. A complex comprising the fusion protein of claim 18 and a guide RNA bound to the napDNAbp of the fusion protein.

26. A method for editing a target nucleic acid molecule, the method comprising contacting the target nucleic acid molecule with the fusion protein of claim 18 and a guide RNA, wherein the guide RNA comprises at least 10 contiguous nucleotides complementary to the target nucleic acid molecule, thereby editing the target nucleic acid molecule.

* * * * *